US012281147B2

(12) United States Patent
Goodnight et al.

(10) Patent No.: US 12,281,147 B2
(45) Date of Patent: Apr. 22, 2025

(54) INTERLEUKIN 21 VARIANTS

(71) Applicant: A-Alpha Bio, Inc., Seattle, WA (US)

(72) Inventors: Davis Goodnight, Seattle, WA (US); Emily Engelhart, Seattle, WA (US); Ryan Swanson, Seattle, WA (US)

(73) Assignee: A-Alpha Bio, Inc., Seattle, WA (US)

( * ) Notice: Subject to any disclaimer, the term of this patent is extended or adjusted under 35 U.S.C. 154(b) by 0 days.

(21) Appl. No.: 18/804,738

(22) Filed: Aug. 14, 2024

(65) Prior Publication Data

US 2025/0059247 A1 Feb. 20, 2025

Related U.S. Application Data

(60) Provisional application No. 63/574,538, filed on Apr. 4, 2024, provisional application No. 63/519,389, filed on Aug. 14, 2023.

(51) Int. Cl.
*C07K 14/54* (2006.01)
*C07K 16/28* (2006.01)

(52) U.S. Cl.
CPC .............. *C07K 14/54* (2013.01); *C07K 16/28* (2013.01); *C07K 2319/33* (2013.01)

(58) Field of Classification Search
None
See application file for complete search history.

(56) References Cited

U.S. PATENT DOCUMENTS

| | | | |
|---|---|---|---|
| 5,866,692 | A | 2/1999 | Shitara et al. |
| 5,997,867 | A | 12/1999 | Waldmann et al. |
| 10,988,759 | B2 | 4/2021 | Baker et al. |
| 11,136,573 | B2 | 10/2021 | Baker et al. |
| 11,474,111 | B2 | 10/2022 | Younger et al. |
| 11,726,097 | B2 | 8/2023 | Younger et al. |
| 11,820,970 | B2 | 11/2023 | Baker et al. |
| 2002/0025304 | A1 | 2/2002 | Croze et al. |
| 2002/0137677 | A1 | 9/2002 | Sprecher et al. |
| 2005/0124044 | A1 | 6/2005 | Cunningham et al. |
| 2008/0166319 | A1 | 7/2008 | Schreiber et al. |
| 2010/0196309 | A1 | 8/2010 | Bondensgaard et al. |
| 2020/0071375 | A1 | 3/2020 | Kotenko et al. |
| 2021/0324028 | A1 | 10/2021 | Yeung et al. |
| 2022/0251543 | A1 | 8/2022 | Younger et al. |
| 2024/0309062 | A1 | 9/2024 | Engelhart et al. |

FOREIGN PATENT DOCUMENTS

| | | |
|---|---|---|
| WO | WO 1999/58572 | 11/1999 |
| WO | WO 2013/059885 A2 | 5/2013 |

OTHER PUBLICATIONS

Shen et al., Engineered IL-21 Cytokine Muteins Fused to Anti-PD-1 Antibodies Can Improve CD8+ T Cell Function and Anti-tumor Immunity. Front. Immunol., vol. 11, Article 832, pp. 1-14, May 7, 2020.*
PCT International Search Report and Written Opinion in International Appln. No. PCT/US2024/020211, mailed on Aug. 13, 2024, 13 pages.
Wilkinson et al., "Systematic analysis of the varied designs of 819 therapeutic antibodies and Fc fusion proteins assigned international nonproprietary names," Mabs, Dec. 2022, 4(1):2123299, 15 pages.
Younger et al., "High-throughput characterization of protein-protein interactions by reprogramming yeast mating," Proceedings of the National Academy of Sciences, Nov. 2017, 114(46):12166-71.
Malhotra, "Tagging for protein expression," Methods in Enzymology, Jan. 2009, 463:239-58.
PCT International Search Report and Written Opinion in International Appln. No. PCT/US2024/042270, mailed on Feb. 14, 2025, 14 pages.

* cited by examiner

*Primary Examiner* — Ruixiang Li
(74) *Attorney, Agent, or Firm* — Fish & Richardson P.C.

(57) ABSTRACT

The disclosure provides interleukin 21 (IL-21) variants that have (i) decreased or no binding to a human interleukin 21 receptor (IL-21R) as compared to a wild-type human IL-21 polypeptide; or (ii) increased stability as compared to a wild-type human IL-21 polypeptide; or (iii) decreased or no binding to a human interleukin 21 receptor (IL-21R) as compared to a wild-type human IL-21 polypeptide and increased stability as compared to a wild-type human IL-21 polypeptide. The disclosure also provides fusion proteins including an antibody or fragment thereof bound, e.g., covalently linked, to an IL-21 variant.

19 Claims, 54 Drawing Sheets

Specification includes a Sequence Listing.

| IL-21 | Human | Cyno | Mouse | Rat |
|---|---|---|---|---|
| Human | 3.1 | 3.3 | 4.6 | 4.6 |
| Cyno | 3.6 | 3.7 | 4.7 | 4.7 |
| Mouse | 3.8 | 4.0 | 3.8 | 3.2 |
| Rat | 3.2 | 3.6 | 3.4 | 2.3 |

| IL-21 | Human | Cyno | Mouse | Rat |
|---|---|---|---|---|
| Human | 1.4 | 1.3 | 3.7 | 2.1 |
| Cyno | 1.6 | 1.5 | 3.7 | 4.1 |
| Mouse | 1.3 | 1.4 | 0.9 | 0.8 |
| Rat | 1.4 | 1.4 | 1.0 | 0.9 |

Distribution of wild-type IL-21 replicate affinities to human IL-21R in unbuffered media
(Average = 2.8)

Distribution of wild-type IL-21 replicate affinities to human IL-21R in pH 5 media
(Average = 1.5)

Distribution of wild-type IL-21 replicate affinities to human IL-21R in pH 6 media
(Average = 1.1)

Distribution of wild-type IL-21 replicate affinities to human IL-21R in pH 7 media
(Average = 1.2)

Distribution of parental IL-21_6318 replicate affinites to human IL-21R

INTERLEUKIN 21 VARIANTS

CROSS-REFERENCE TO RELATED APPLICATIONS

This application claims the benefit of U.S. Provisional Patent Application No. 63/519,389, filed Aug. 14, 2023, and U.S. Provisional Patent Application No. 63/574,538, filed Apr. 4, 2024, the contents of which are incorporated herein by reference in their entirety.

SEQUENCE LISTING

The specification further incorporates by reference a Sequence Listing in electronic format. The Sequence Listing.xml file, identified as 52911-0010001.xml, is 3,194,943 bytes in size and was created on Oct. 1, 2024. The information in the electronic format of the Sequence Listing is incorporated herein by reference in its entirety.

TECHNICAL FIELD

The present disclosure provides human interleukin 21 (IL-21) variants and fusion proteins including the IL-21 variants, and methods of making and using them.

BACKGROUND

Cytokines, including IL-21, are potent immune modulators with potential therapeutic value in immuno-oncology and infectious disease. However, in human subjects their potency can present challenges, including only modest efficacies accompanied by significant toxicities and adverse side effects due to immune activation in healthy tissues. Therefore, there exists a need for therapeutic agents based on a targeted cytokine, which would be of great clinical value in treatments of various diseases including cancer.

SUMMARY

The present disclosure provides human interleukin 21 (IL-21) variants and fusion proteins including those variants and methods for measuring binding affinities between IL-21 variants and the human interleukin 21 receptor (IL-21R). The provided IL-21 variants and fusion proteins comprising IL-21 variants can have therapeutic use. Also provided are methods of stimulating an immune response or suppressing cellular/tumor proliferation in a mammal, and methods of treating a disorder (e.g., cancer) using the IL-21 variants or the fusion proteins of such IL-21 variants.

In a therapeutic context, these cytokine variants can be targeted to a particular target cell, e.g., a type of immune cell, of interest by linking the cytokine to an antibody or portion thereof against a specific cell surface marker of the target cell. To ensure immune activation occurs primarily or only at the cell type of interest, the disclosure provides "detuned" cytokine variants, e.g., IL-21 variants, with weakened affinity for their receptors (in this case, IL-21 variants with weakened affinity for interleukin 21 receptor (IL-21R)). Detuning the cytokine can decrease or eliminate toxicities and adverse side effects by localizing the cytokine activity to specific cellular or tumor contexts. By reducing affinity for the receptor, the activity of the detuned cytokines is decreased for most cell types, e.g., in healthy tissues, which, in turn, decreases potential toxicity of the molecule when administered as a therapy. However, at the surface of the cell type targeted by the antibody, the residual activity of the cytokine is sufficient to bind its receptor and activate pro-inflammatory pathways leading to immune activation.

The compositions and methods provided herein are based, at least in part, on the identification of IL-21 variants with decreased affinity for the IL-21R receptor by high-throughput screening using a protein-protein interaction (PPI) assay based on a yeast sexual agglutination method, termed AlphaSeq™ (see, e.g., U.S. Pat. Nos. 10,988,759 and 11,136,573).

Also described herein are IL-21 variants that exhibit increased stability, either expressed alone or in the context of a fusion protein. Given the biophysical liabilities of IL-21, stabilization of an IL-21 therapeutic is desirable. Stabilization can include various parameters and be measured in by various methods known in the art. Increased stability can include higher expression titers in cells, e.g., CHO cells, during manufacturing; increased monomeric species of interest measured by analytical size exclusion chromatography (SEC) following purification; or higher melting temperature in differential scanning fluorimetry (DSF). Additionally, stabilized can have longer half-lives in serum stability assays in vitro or enhanced pharmacokinetic properties when administered to an animal or patient as a drug.

Cytokine signaling can trigger multifaceted and even opposing activities in different cell types, often leading to toxicity or poor response rates in the therapeutic setting. Targeting specific cellular signaling, such as defined immune subsets or antigen experienced cells at the tumor, has the potential to widen a cytokine therapeutic index and improve patient outcomes.

In a first aspect, the disclosure provides human interleukin 21 (IL-21) variants, wherein the IL-21 variants each have (i) decreased or no binding to a human interleukin 21 receptor (IL-21R) as compared to a wild-type human IL-21 polypeptide; or (ii) increased stability as compared to a wild-type human IL-21 polypeptide; or (iii) decreased or no binding to a human interleukin 21 receptor (IL-21R) as compared to a wild-type human IL-21 polypeptide and increased stability as compared to a wild-type human IL-21 polypeptide. In some embodiments, the IL-21 variant has a binding affinity to the human IL-21R that is decreased by 1.5-fold, 2-fold, 3-fold, 5-fold, 10-fold, 50-fold, 100-fold, 500-fold, 1000-fold, 2000-fold, or 3000-fold, or more, relative to the binding affinity between the wild-type human IL-21 polypeptide and the human IL-21R.

In some embodiments, the IL-21 variant includes one or more amino acid substitutions at one or more positions of SEQ ID NO: 1 selected from the group consisting of: Q32, D33, R34, H35, M36, 137, R38, M39, Q41, L42, 143, D44, 145, V46, D47, Q48, L49, N51, Y52, V53, N54, D55, L56, V57, P58, E59, F60, L61, P62, A63, E65, D66, V67, E68, N70, E72, W73, S74, A75, F76, S77, F79, Q80, K81, A82, Q83, L84, K85, S86, A87, N88, T89, G90, N92, E93, R94, 195, 196, N97, V98, S99, K101, I100, K102, L103, K104, R105, K106, P107, P108, S109, T110, N111, A112, G113, R114, R115, H118, L120, K131, P132, P133, R139, S142, L144, Q145, 1148, Q150, H151, and L152.

In some embodiments, the IL-21 variant includes one or more amino acid substitutions selected from the group consisting of: Q32K, Q32I, D33H, D33A, D33N, D33P, D33Q, D33R, D33S, D33T, D33W, D33V, R34A, R34D, R34E, R34F, R34G, R34H, R34K, R34L, R34M, R34N, R34P, R34Q, R34S, R34T, R34V, R34W, R34Y, H35P, H35I, H35F, M36T, M36R, M36P, 137E, 137G, I37K, I37N, 137Q, 137R, 137S, I37V, I37P, I37A, I37W, 137H, 137D, 137T, 137F, R38A, R38P, R38E, R38F, R38K, R38M, R38Q, R38V, R38W, R38N, R38G, R38L, R38S, R38T, R38I, R38D, M39D, M39E, M39G, M39I, M39K, M39P, M39Q, M39R, M39A, Q41K, Q41P, Q41S, Q41E, Q41D, Q41W, Q41R, L42D, L42E, L42G, L42H, L42K, L42N, L42Q, L42R, L42S, L42Y, I43D, I43L, I43M, I43P, I43S, I43Y, I43F, I43R, D44A, D44G, D44N, D44P, D44T, D44W, D44Y, D44F, D44Q, D44S, D44V, D44M, D44L, D44P, D44H, D44R, D44K, I45A, I45D, 145G, I45H, I45N, I45P, I45R, I45S, I45Y, I45T, I45Q, I45F, I45W, I45K, V46D, V46E, V46G, V46K, V46N, V46P, V46Q, V46T, D47P, D47S, D47R, D47K, D47F, D47G, Q48G, Q48K, Q48R, L49D, L49E, L49H, L49K, L49N, L49P, L49R, L49S, L49F, N51E, N51G, N51P, N51V, Y52D, Y52H, Y52K, Y52N, Y52Q, Y52S, Y52T, Y52R, Y52G, V53A, V53E, V53H, V53N, V53P, V53Q, V53S, V53T, V53M, N54H, N54K, N54P, D55K, D55R, D55Y, D55M, L56E, L56F, L56M, L56N, L56S, L56T, L56V, L56D, V57H, V57L, V57M, V57P, V57R, V57T, V57Y, P58M, P58K, E59R, E59S, E59V, E59Y, F60H, F60I, F60R, L61H, L61I, L61K, P62H, P62S, P62T, P62V, P62L, A63T, E65R, D66M, D66R, D66K, V67L, V67K, V67G, E68K, E68R, E68G, N70A, N70H, N70G, E72H, E72I, E72L, E72S, E72T, E72R, E72W, W73A, W73G, W73K, W73L, W73N, W73P, W73Q, W73S, W73T, W73V, W73Y, S74A, S74H, S74N, S74R, S74K, A75N, A75Y, A75V, F76D, F76E, F76H, F76M, F76P, F76Q, F76R, F76T, F76S, F76L, F76V, F76I, F76K, S77K, S77M, S77R, S77W, F79D, F79E, F79K, F79P, F79R, F79T, F79Y, F79I, F79A, F79L, F79V, Q80A, Q80D, Q80L, Q80M, Q80V, Q80I, Q80E, Q80N, Q80H, Q80W, Q80F, Q80K, Q80R, Q80G, Q80Y, K81D, K81H, A82V, A82W, A82M, A82K, A82L, A82I, A82H, A82T, A82Y, A82V, Q83L, Q83W, Q83F, Q83K, Q83H, Q83V, L84P, L84F, L84T, K85S, K85P, S86I, S86M, S86L, S86R, A87N, A87P, N88K, N88R, T89L, T89F, G90Y, G90Q, G90I, G90K, N92G, N92Y, N92W, N92P, E93G, E93T, E93R, E93F, E93P, E93K, E93S, E93V, E93I, E93Y, R94S, R94T, 195H, 195K, 195P, 195T, 195R, 195G, 196A, 196D, 196G, 196P, 196S, 196T, 196V, 196F, 196Y, 196E, 196Q, 196M, 196H, 196N, 196R, 196K, N97G, N97P, N97H, N97W, N97K, N97R, V98H, V98K, V98R, V98E, V98A, V98G, V98Y, V98N, V98S, V98M, V98T, V98P, V98F, S99H, S99R, S99P, S99K, S99G, I100E, I100R, I100S, I100D, I100G, I100F, I100Y, I100Q, I100H, I100A, I100R, K101E, K101D, K102P, K102G, K102L, K102V, K102E, K102I, K102T, K102D, L103E, L103A, L103S, L103T, L103F, L103I, L103W, L103Y, L103V, L103Q, L103H, L103N, K104G, K104P, R105A, R105D, R105K, R105Q, R105S, R105W, R105Y, R105L, R105H, R105M, R105F, R105N, R105I, R105V, R105T, R105E, R105G, R105P, K106E, K106N, K106P, K106S, K106T, K106G, K106H, K106D, P107D, P107Y, P107V, P107H, P107V, P107K, P107R, P108D, P108E, P108G, P108I, P108L, P108Q, P108T, P108A, P108H, P108K, P108Y, P108M, P108N, P108W, P108R, S109K, S109M, S109R, T110D, T110S, T110H, T110N, N111R, N111K, A112P, A112R, A112K, G113R, G113H, R114F, R114Q, R115I, R115P, R115Q, R115D, H118I, H118K, H118R, L120H, L120K, L120M, L120V, L120Y, L120S, K131M, K131V, P132A, P133I, R139S, S142D, S142H, S142I, L144M, Q145H, 1148S, Q150D, Q150R, Q150S, H151E, and L152H.

In some embodiments, the IL-21 variant is has at least 90%, 95%, 98%, 99%, or 100% sequence identity to any one of SEQ ID NOs: 462, 463, 1192, 950, 933, and 894. In some embodiments, the IL-21 variant includes one or more substitutions selected from the group consisting of R105W, R105L, R38N, R38L, R105Y, and R38W. In some embodiments, the IL-21 variant includes a polypeptide sequence selected from one of SEQ ID NOs: 15-3117.

In another aspect, the disclosure provides fusion proteins including an antibody or binding fragment thereof and a human IL-21 variant, wherein the IL-21 variant is covalently linked to the antibody or binding fragment thereof.

In another aspect, the disclosure provides a fusion protein including an antibody or binding fragment thereof including an Fc domain and a human IL-21 variant, wherein the IL-21 variant is covalently linked to the Fc domain of the antibody or binding fragment thereof.

In some embodiments, the antibody or binding fragment thereof includes an amino acid sequence 80%, 90%, 95%, 96%, 97%, 98%, 99%, or 100% identical to an amino acid sequence selected from the group consisting of SEQ ID NO: 5, 6, 7, 8, 9, 10, 11, 12, 13, or 14. In some embodiments, the antibody or binding fragment thereof includes a human antibody Fc domain including an effectorless mutations selected from NG, DANG, LALA, and LALA-PG. In some embodiments, the antibody binds to an antigen selected from the group consisting of CD8, TIGIT, PD-1, CD160, BTLA, CD25, ICOS and TNFRSF9.

In some embodiments, the antibody is selected from the group consisting of an anti-CTLA-4 antibody, an anti-CD3 antibody, an anti-CD4 antibody, an anti-CD8 antibody, an anti-4-1 BB antibody, an anti-PD-I antibody, an anti-PD-L1 antibody, an anti-TIM3 antibody, an anti-LAG3 antibody, an anti-TIGIT antibody, an anti-OX40 antibody, an anti-IL-7Ralpha (CD127) antibody-, an anti-HVEM antibody, an anti-BTLA antibody, an anti-CD40 antibody, an anti-CD40L antibody, anti-CD47 antibody, an anti-CSFIR antibody, an anti-MARCO antibody, an anti-CXCR4 antibodies, an anti-VEGFR1 antibody, an anti-VEGFR2 antibody, an anti-TNFR1 antibody, an anti-TNFR2 antibody, an anti-CD3 bispecific antibody, an anti-CD19 antibody, an anti-CD20, an anti-Her2 antibody, an anti-EGFR antibody, an anti-ICOS antibody, an anti-CD22 antibody, an anti-CD52 antibody, an anti-CCR4 antibody, an anti-CCR5 antibody, an anti-CD200R antibody, an anti-VISG4 antibody, an anti-CCR2 antibody, an anti-LILRB2 antibody, an anti-CXCR4 antibody, an anti-CD206 antibody, an anti-CD163 antibody, an anti-KLRGl antibody, an anti-FLT3 antibody, an anti-B7-H4 antibody, an anti-B7-H3 antibody, an KLRGl antibody, and an anti-GITR antibody, anti-CD160 antibody, anti-KLRD1 antibody, anti-KLRC1 antibody, anti-BTLA antibody, anti-LILRB4 antibody.

In some embodiments, the IL-21 variant is covalently linked to the antibody by a polypeptide linker. In some embodiments, the polypeptide linker is selected from the group consisting of (G4S) 2 (SEQ ID NO:3120) and (G4S) 3 (SEQ ID NO:3121). In some embodiments, the polypeptide linker is a polypeptide tag selected from the group consisting of FLAG, MYC, HA, and 6Xhis (SEQ ID NO:3118).

In another aspect, the disclosure provides cell lines that produce IL-21 variants or fusion proteins including IL-21 variants. In some embodiments, the cell line is a CHO cell line or HEK293 cell line.

In another aspect, the disclosure provides nucleic acids encoding IL-21 variants or fusion proteins including IL-21 variants. In another aspect, the disclosure provides recombinant expression vectors including nucleic acids encoding IL-21 variants or fusion proteins including IL-21 variants. In another aspect, the disclosure provides host cells including either nucleic acids encoding IL-21 variants or fusion proteins including IL-21 variants or recombinant expression vectors including nucleic acids encoding IL-21 variants or fusion proteins including IL-21 variants.

In another aspect, the disclosure provides pharmaceutical compositions including IL-21 variants fusion protein including IL-21 variants, and a pharmaceutically acceptable carrier.

In another aspect, the disclosure provides methods of treating a disease in a subject in need thereof, the method including administering to the subject the pharmaceutical composition in an amount effective to reduce one or more symptoms associated with the disease in the subject. In some embodiments, the disease is cancer. In some embodiments, the cancer is a solid cancer or a liquid cancer.

In some embodiments, the solid cancer is selected from the group consisting of gastric cancer, small intestine cancer, sarcoma, head and neck cancer, thymic cancer, epithelial cancer, salivary cancer, liver cancer, biliary cancer, neuroendocrine tumors, stomach cancer, thyroid cancer, lung cancer, mesothelioma, ovarian cancer, breast cancer, prostate cancer, esophageal cancer, pancreatic cancer, glioma, renal cancer, bladder cancer, cervical cancer, uterine cancer, vulvar cancer, penile cancer, testicular cancer, anal cancer, choriocarcinoma, colorectal cancer, oral cancer, skin cancer, Merkel cell carcinoma, glioblastoma, brain tumor, bone cancer, eye cancer, and melanoma.

In some embodiments, the liquid cancer is selected from the group consisting of multiple myeloma, malignant plasma cell neoplasm, Hodgkin's lymphoma, nodular lymphocyte predominant Hodgkin's lymphoma, Kahler's disease and Myelomatosis, plasma cell leukemia, plasmacytoma, B-cell prolymphocytic leukemia, hairy cell leukemia, B-cell non-Hodgkin's lymphoma (NHL), acute myeloid leukemia (AML), chronic lymphocytic leukemia (CLL), acute lymphocytic leukemia (ALL), chronic myeloid leukemia (CML), follicular lymphoma, Burkitt's lymphoma, marginal zone lymphoma, mantle cell lymphoma, large cell lymphoma, precursor B-lymphoblastic lymphoma, myeloid leukemia, Waldenstrom's macroglobulienemia, diffuse large B cell lymphoma, follicular lymphoma, marginal zone lymphoma, mucosa-associated lymphatic tissue lymphoma, small cell lymphocytic lymphoma, mantle cell lymphoma, Burkitt lymphoma, primary mediastinal (thymic) large B-cell lymphoma, lymphoplasmactyic lymphoma, Waldenstrom macroglobulinemia, nodal marginal zone B cell lymphoma, splenic marginal zone lymphoma, intravascular large B-cell lymphoma, primary effusion lymphoma, lymphomatoid granulomatosis, T cell/histiocyte-rich large B-cell lymphoma, primary central nervous system lymphoma, primary cutaneous diffuse large B-cell lymphoma (leg type), EBY positive diffuse large B-cell lymphoma of the elderly, diffuse large B-cell lymphoma associated with inflammation, intravascular large B-cell lymphoma, ALK-positive large B-cell lymphoma, plasmablastic lymphoma, large B-cell lymphoma arising in HHVS-associated multicentric Castleman disease, B-cell lymphoma unclassified with features intermediate between diffuse large B-cell lymphoma and Burkitt lymphoma, B-cell lymphoma unclassified with features intermediate between diffuse large B-cell lymphoma and classical Hodgkin lymphoma, and other hematopoietic cells related cancer. In some embodiments, the cancer is relapsed, refractory, or metastatic.

In some embodiments, the method further includes administering an effective amount of a second therapeutic agent, optionally wherein the administration is separate, sequential, or simultaneous. In some embodiments, the second therapeutic agent is an antibody selected from the group consisting of an anti-CTLA-4 antibody, an anti-CD3 antibody, an anti-CD4 antibody, an anti-CD8 antibody, an anti-4-1BB antibody, an anti-PD-1 antibody, an anti-PD-L1 antibody, an anti-TIM3 antibody, an anti-LAG3 antibody, an anti-TIGIT antibody, an anti-OX40 antibody, an anti-IL-7Ralpha (CD127) antibody, an anti-IL-8 antibody, an anti-IL-15 antibody, an anti-HVEM antibody, an anti-BTLA antibody, an anti-CD40 antibody, an anti-CD40L antibody, anti-CD47 antibody, an anti-CSFIR antibody, an anti-CSFl antibody, an anti-IL-7R antibody, an anti-MARCO antibody, an antiCXCR4 antibodies, an anti-VEGF antibody, an anti-VEGFR1 antibody, an anti-VEGFR2 antibody, an anti-TNFR1 antibody, an anti-TNFR2 antibody, an anti-CD3 bispecific antibody, an anti-CD19 antibody, an anti-CD20, an anti-Her2 antibody, an anti-EGFR antibody, an anti-ICOS antibody, an anti-CD22 antibody, an anti-CD 52 antibody, an anti-CCR4 antibody, an anti-CCRS antibody, an antiCD200R antibody, an anti-VISG4 antibody, an anti-CCR2 antibody, an anti-LILRb2 antibody, an anti-CXCR4 antibody, an anti-CD206 antibody, an anti-CD163 antibody, an anti-KLRGl antibody, an anti-FLT3 antibody, an anti-B7-H4 antibody, an anti-B7-H3 antibody, an KLRGl antibody, a BTNlAl antibody, and an anti-GITR antibody.

In some embodiments, the second therapeutic agent is a cytokine, an immunocytokine, TNFa, a PAP inhibitor, an oncolytic virus, a kinase inhibitor, an ALK inhibitor, a MEK inhibitor, an IDO inhibitor, a GLSl inhibitor, a tyrosine kinase inhibitor, a CART cell or T cell therapy, a TLR agonist, or a tumor vaccine.

In another aspect, the disclosure provides pharmaceutical compositions for use in the treatment of cancer, optionally wherein the cancer is a solid cancer or a liquid cancer and/or the cancer is relapsed, refractory, or metastatic. In some embodiments, the use is in combination with a second therapeutic agent, optionally wherein the combination is for administration simultaneously, concurrently, or simultaneously.

As used herein, two polynucleotide or polypeptide sequences are said to be "identical" if the sequence of nucleotides or amino acids in the two sequences is the same when aligned for maximum correspondence as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, or 40 to about 50, in which a sequence may be compared to a reference sequence of the same number of contiguous positions after the two sequences are optimally aligned.

Optimal alignment of sequences for comparison as disclosed herein is conducted using the MegAlign® program in the Lasergene® suite of bioinformatics software (DNASTAR®, Inc., Madison, Wis.), using default parameters. This program embodies several alignment schemes described in the following references: Dayhoff, M. 0., 1978, A model of evolutionary change in proteins-Matrices for detecting distant relationships. In Dayhoff, M. O. (ed.) Atlas of Protein Sequence and Structure, National Biomedical Research Foundation, Washington D.C. Vol. 5, Suppl. 3, pp. 345-358; Hein J., 1990, Unified Approach to Alignment and Phylogenes, pp. 626-645 Methods in Enzymology vol. 183, Academic Press, Inc., San Diego, Calif.; Higgins, D. G. and Sharp, P. M., 1989, CABIOS 5:151-153; Myers, E. W. and Muller W., 1988, CABIOS 4:11-17; Robinson, E. D., 1971, Comb. Theor. 11:105; Santou, N., Nes, M., 1987, Mol. Biol. Evol. 4:406-425; Sneath, P. H. A. and Sokal, R. R., 1973, Numerical Taxonomy the Principles and Practice of Numerical Taxonomy, Freeman Press, San Francisco, Calif.; Wilbur, W. J. and Lipman, D. J., 1983, Proc. Natl. Acad. Sci. USA 80:726-730.

As defined herein, a "percentage of sequence identity" is determined by comparing two optimally aligned sequences over a window of comparison of at least 20 positions, wherein the portion of the polynucleotide or polypeptide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical nucleic acid bases or amino acid residue occurs in both sequences to yield the number of matched positions, dividing the number of matched positions by the total number of positions in the reference sequence (i.e., the window size) and multiplying the results by 100 to yield the percentage of sequence identity.

As used herein, "protein-protein interaction" or "PPI" refers to physical contacts of high specificity established between two or more proteins (or polypeptides) as a result of biochemical events driven by electrostatic forces including the hydrophobic effect. Many are physical contacts with molecular associations between chains that occur in a cell or in a living organism in a specific biomolecular context. In some embodiments, the protein-protein interactions are strong enough to replace the function of the native sexual agglutination proteins. For example, it can be possible to couple mating efficiency to the interaction strength of a particular protein-protein interaction. In certain embodiments, the assay can characterize or determine protein-protein interactions between synthetic adhesion proteins (SAPs).

As used herein, a "synthetic adhesion protein" refers to any protein or polypeptide to be assayed for binding to or interacting with any other protein or polypeptide. The proteins can be heterologous or exogenously expressed. Synthetic adhesion proteins are referred to as such because they are not typically associated with the adhesion required for agglutination as natively performed by the sexual agglutination proteins. In certain embodiments, the synthetic adhesion proteins have sufficiently strong interactions to allow agglutination in yeast where the native sexual agglutination proteins are not natively expressed. In some embodiments, the SAPs of the first and second expression cassettes of the first and second nucleic acid constructs, respectively, bind to a cell wall GPI anchored protein. In some embodiments, the SAPs can be fused to a cell wall GPI anchored protein or fused to a protein that forms a disulfide bond with a cell wall GPI anchored protein. In some embodiments, the SAP of the first expression cassette of the first nucleic acid construct is fused to the sexual agglutination protein Aga2, and the SAP of the first expression cassette of the second nucleic acid construct is fused to the sexual agglutination protein Aga2.

As used herein, "affinity" is a measure of the strength of the binding interaction between a single biomolecule to its ligand or binding partner. Affinity is usually measured and described using the equilibrium dissociation constant, $K_d$. The lower the $K_d$ value, the greater the affinity between the protein and its binding partner. Affinity may be affected by hydrogen bonding, electrostatic interactions, hydrophobic and Van der Waals forces between the binding partners, or by the presence of other molecules, e.g., binding agonists or antagonists.

In some implementations, affinity may be described using arbitrary units, wherein a certain binding affinity within an assay, for example, the binding affinity between two wild-type protein binding partners or the wild-type species of a first protein binding partner and the wild-type species of a second protein binding partner, is set to an arbitrary unit of 1.0 and binding affinities for other pairs of protein binding partners, for example the mutant species of a first protein binding partner and the mutant species of a second protein binding partner, are measured relative proportionally to that certain binding affinity.

Unless otherwise defined, all technical and scientific terms used herein have the same meaning as commonly understood by one of ordinary skill in the art to which this invention belongs. Methods and materials are described herein for use in the present invention; other, suitable methods and materials known in the art can also be used. The materials, methods, and examples are illustrative only and not intended to be limiting. All publications, patent applications, patents, sequences, database entries, and other references mentioned herein are incorporated by reference in their entirety. In case of conflict, the present specification, including definitions, will control.

Other features and advantages of the invention will be apparent from the following detailed description and figures, and from the claims.

DESCRIPTION OF DRAWINGS

FIG. 1A is a heatmap of AlphaSeq™ predicted affinities (log 10 $K_d$ nM) for the IL-21/IL-21R validation network in standard media conditions. Strong binding is considered below 3, weak binding is considered between 3 and 4, no binding is considered above 4.

FIG. 1B is a heatmap of AlphaSeq™ predicted affinities (log 10 $K_d$ nM) for the IL-21/IL-21R validation network in pH 7 buffered conditions. Strong binding is considered below 2, weak binding is considered between 2 and 3.5, no binding is considered above 3.5.

DETAILED DESCRIPTION

Figure 2A:
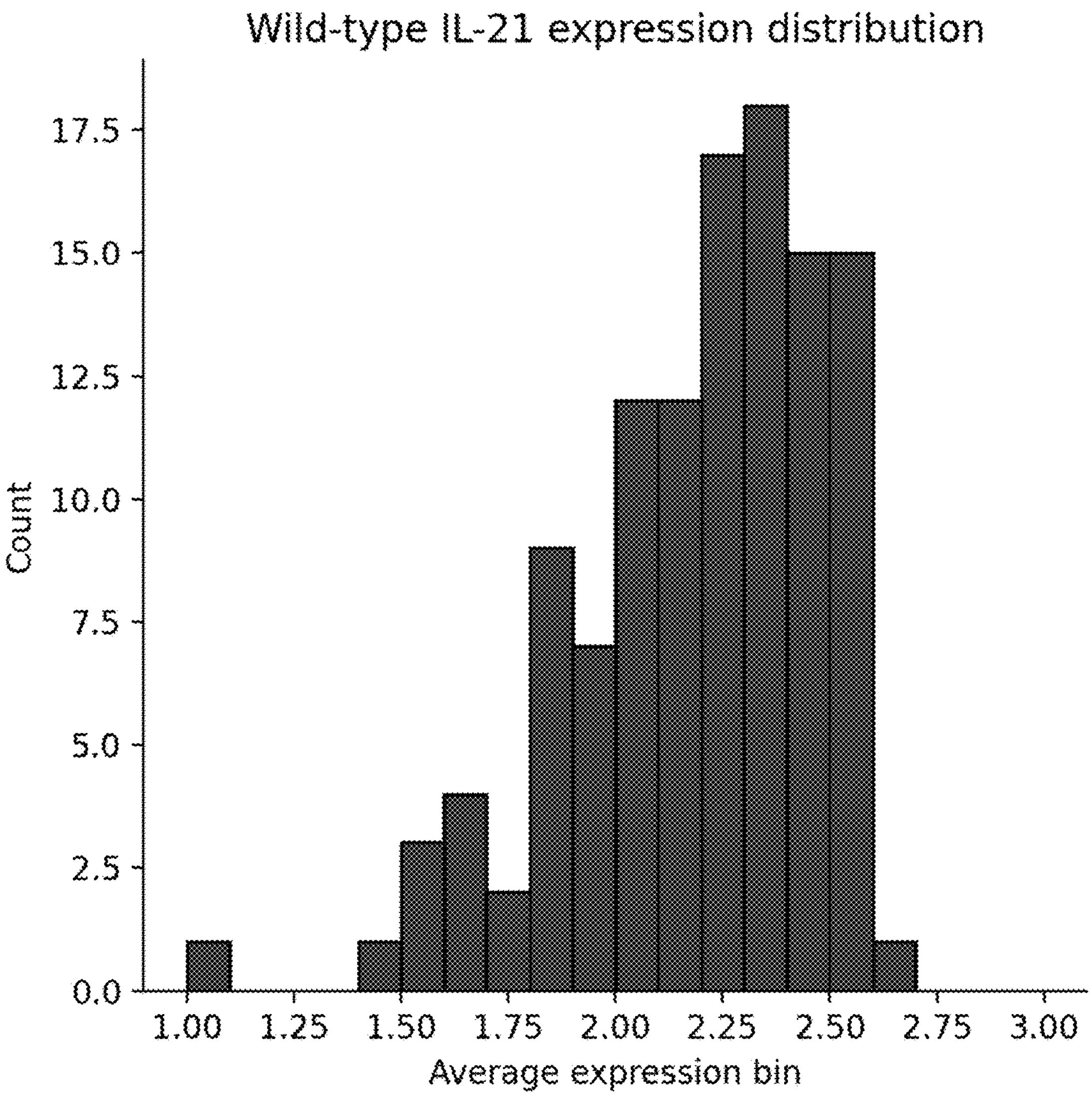
FIG. 2A is a histogram of expression values for wild-type replicates of human IL-21. A value of 3 is the maximum possible expression in this assay and a value of 1 is the minimum possible expression.

The present disclosure provides human interleukin 21 (IL-21) variants and fusion proteins including those variants. In some embodiments, the IL-21 variants are detuned IL-21 variants. "Detuned" means that the wildtype IL-21 is engineered to have a reduced or weakened affinity for the interleukin 21 receptor (IL-21R). Different modifications of the wildtype IL-21 results in a large number of detuned IL-21 variants.

Also described herein are IL-21 variants that exhibit increased stability, either expressed alone or in the context of a fusion protein. Given the biophysical liabilities of IL-21, stabilization of an IL-21 therapeutic is desirable. Stabilization can include various parameters and be measured in by various methods known in the art. Increased stability can include higher expression titers in cells, e.g., CHO cells, during manufacturing; increased monomeric species of interest measured by analytical size exclusion chromatography (SEC) following purification; or higher melting temperature in differential scanning fluorimetry (DSF). Additionally, stabilized can have longer half-lives in serum stability assays in vitro or enhanced pharmacokinetic properties when administered to an animal or patient as a drug.

The IL-21 variants disclosed herein can be detuned, exhibit increased stability, or both. In a therapeutic context, these IL-21 variants can be targeted to particular types of target cells, e.g., types of immune cells, of interest by linking, e.g., covalently linking, the detuned variants to an antibody or portion thereof against a specific cell surface marker. By reducing affinity for the receptor, the activity of the detuned cytokines is decreased for other cell types, e.g., in healthy tissues, which, in turn, decreases potential toxicity of the molecule when administered as a therapy. However, at the surface of the cell type targeted by the antibody, the residual activity of the cytokine is sufficient to bind its receptor and activate pro-inflammatory pathways leading to immune activation.

Cytokine signaling can trigger multifaceted and even opposing activities in different cell types, meaning that even if cytokine activity is limited specifically to the cells expressing the antibody, targeted antigen activation of other cell types may be detrimental to the therapeutic efficacy of the cytokine. Targeting cytokine-dependent activation to only a subset of the immune cells present in a tumor, for example, activated T cells as opposed to all cells with a cytokine receptor, can allow improved targeting of the therapeutic effects of the molecule.

The compositions disclosed herein are human IL-21 variants and fusion proteins made from these variants. As measured by, e.g., AlphaSeq™, and demonstrated in further detail in the Examples below, the IL-21 variants of the compositions and methods disclosed herein have decreased or no binding to the IL-21R receptor, as compared to the wild-type human IL-21 polypeptide or a wild-type IL-21 fusion polypeptide. In some embodiments, these reduced affinity IL-21 variants, when presented as an antibody fusion chimeric protein, are targeted selectively to desired cell types (those cells expressing the antibody target). Cell types that express the IL-21R receptor complex, but not the antibody target, are activated at a reduced level, or not activated at all, compared to those cells that express both components.

Accordingly, the IL-21 variants and the IL-21 fusion proteins of the compositions and methods disclosed herein selectively modulate the activation of cell subsets to promote biological activity, such as an anti-tumor activity, efficaciously and safely.

Methods of Determining IL-21 Variants

In some embodiments, measuring the affinity of the cytokine IL-21 to its receptor IL-21R is performed using a high-throughput synthetic yeast agglutination protein-protein interaction (PPI) screening platform termed AlphaSeq™. Synthetic yeast agglutination relies on reprogramming yeast sexual agglutination-a naturally-occurring protein-protein interaction-to link protein-protein interaction strength with mating efficiency between a-type recombinant haploid yeast cells and a-type recombinant haploid yeast cells in liquid culture. For a screen of IL-21 variants for binding affinity to IL-21R based on synthetic yeast agglutination, mating efficiency, represented by the number of diploid yeast cells formed in a turbulent liquid culture, is a proxy for affinity between IL-21 and IL-21R.

The AlphaSeq™ method is disclosed in, e.g., U.S. Pat. Nos. 10,988,759 and 11,136,573, which are incorporated herein by reference in their entireties. AlphaSeq™ can be used to perform library-by-library screens of a library of variants of one protein binding partner, e.g., IL-21, against a library of variants of another protein binding partner, e.g., IL-21R. AlphaSeq™ can be also used to perform a library-based screen of a library of variants of one protein binding partner, e.g., IL-21, against a single species of another protein binding partner, e.g., wild-type human IL-21R or wild-type mouse IL-21R. Each variant, i.e., protein of interest (POI) is assigned a unique oligonucleotide molecular barcode, and after diploid formation events, these protein-specific barcodes can be recombined and sequenced to identify the individual synthetic adhesion proteins (SAPs) that mediated the corresponding diploid formation event. Quantifying sequencing reads of unique barcode-barcode combinations acts as a proxy measure of the number of diploid formation events, and thus, PPI affinity.

In native yeast sexual agglutination, in a turbulent liquid culture, MATa and MATa haploid cells stick to one another due to the binding of sexual agglutinin proteins, which allows them to mate. The native sexual agglutinin proteins consist of Agal and Aga2, expressed by MATa cells, and Sagl, expressed by MATa cells. Agal and Sagl form GPI anchors with the cell wall and extend outside of the cell wall with glycosylated stalks. Aga2 is secreted by MATa cells and forms a disulfide bond with Agal. The interaction between Aga2 and Sagl is essential for wild-type sexual agglutination.

The native sexual agglutinin interaction can be replaced with an engineered one by expressing Agal in both mating types and fusing complementary binders to Aga2. In this case, a synthetic adhesion protein (SAP) comprises the fusion of Aga2 and the binder of interest, e.g., the library of IL-21 variants expressed by cells of one mating type and IL-21R expressed by cells of the other mating type. Interaction of the SAPs therefore mediates adhesion, and subsequently the agglutination process. In some embodiments, instead of direct agglutination, it may be possible to express SAPs for a multivalent target, such that agglutination and mating only occurs in the presence of the target.

In some embodiments, each MATa and MATa haploid cell contains an SAP fused to Aga2 integrated into a target chromosome (for example, chromosome III). Upon mating, both copies of the target chromosome are present in the same diploid cell. In addition to the SAP/Aga2 cassette, each copy of the target chromosome has a unique primer binding site, one of a plurality of unique oligonucleotide barcodes operably linked to the particular SAP, and a lox recombination site.

The plurality of oligonucleotide barcodes can be synthesized and assembled with the library of SAP expression cassettes such that a single SAP species is operably linked to a plurality of unique oligonucleotide barcodes. Upon expression of Cre recombinase, a chromosomal translocation occurs at the lox sites, resulting in a juxtaposition of the primer binding sites and barcodes onto the same copy of the target chromosome. A PCR is then performed to amplify a region of the chromosome containing the barcodes from both SAPs, such that sequences comprising unique barcode-barcode pairs, each representing a diploid formation event, are amplified. In a batched mating, the result is a pool of fragments, each containing the unique barcode-barcode pair associated with two SAPs that were responsible for the single diploid formation event. Paired-end next generation sequencing is then used to match the barcodes and determine the number of diploid formation events mediated by that SAP pair.

In some embodiments, the a-agglutinin, Sag1, is knocked out in MATa cells to eliminate native agglutination. MATa and MATα cells are unable to synthesize lysine or leucine, respectively. Diploids can then be selected for in media lacking both amino acids. MATa cells express ZEV4, a βE inducible transcription factor that activates Cre recombinase expression in diploid cells. MATa and MATα cells express mCherry and m Turquoise, respectively, for identification of strain types with flow cytometry. MATa and MATα cells constitutively express Agal along with a uniquely barcoded SAP fused to Aga2. When Cre recombinase expression is induced in diploids with βE, a chromosomal translocation at lox sites consolidates both SAP-Aga2 fusion expression cassettes onto the same chromosome. A single fragment containing the unique barcode-barcode sequence associated with that diploid formation event is then amplified by PCR with primers annealing to Pf and Pr (primers specific to the primers from the first and second nucleic acid constructs integrated at the genomic target site) and sequenced to quantify the number of diploid formation events and identify the interacting SAP pair.

In some embodiments, a CRE recombinase translocation scheme is utilized for high throughput analysis for interactions between synthetic adhesion proteins from a library-to-library screen, or, e.g., the library of IL-21 variants expressed by cells of one mating type and IL-21R expressed by cells of the other mating type. When CRE recombinase expression is induced in diploids with βE, a chromosomal translocation at lox sites consolidates both SAP-Aga2 expression cassettes onto the same chromosome. A single fragment containing the unique barcode-barcode sequence associated with that diploid formation event is then amplified by PCR with primers annealing to primer binding sites from each of the first and second nucleic acid constructs and sequenced (for example, using a paired end analysis of next generation sequencing) to quantify the number of diploid formation events and identify the interacting SAP pair, e.g., a unique variant of IL-21 and IL-21R, thereby yielding an estimation of the affinity between the variant of IL-21 and IL-21R.

In some embodiments, the methods for measuring the affinity of a cytokine and its receptor include a library of cytokine variants, e.g., variants of IL-21, comprising a plurality of cytokine variants and a receptor or library of receptor variants, e.g., IL-21R or variants of IL-21R. The cytokine variants and the receptor variants or library of receptor variants can be user-designated or randomly added mutants of a protein and the wild-type protein. In some embodiments, the amino acid substitutions may be generated by site saturation mutagenesis (SSM) to produce an SSM library of the cytokine and the receptor. In some embodiments, the variants and the receptor variants can be generated by alanine scanning. In some embodiments, the cytokine variants and the receptor variants can be generated by random mutagenesis, such as with error prone PCR, or another method to introduce variation into the amino acid sequence of the expressed protein. The cytokine variant library comprising a plurality of cytokine variants and the receptor variant library comprising a plurality of receptor variants are assayed for binding affinity, such that affinity is measured for interaction between each of the plurality of variants and the wild-type receptor or each of the plurality of receptor variants individually, in a parallelized high-throughput manner.

In some embodiments, AlphaSeq™ can be used to measure affinities in various buffer conditions, including for example unbuffered media, pH 5, pH 6, and pH 7 buffered media. Performing the AlphaSeq™ assay in culture media that is buffered to a lower pH can result in an increased dynamic range for detecting interactions between a cytokine and its receptor, and therefore, increased accuracy and resolution for detecting affinities between cytokine variants and the receptor. Affinities for IL-21 variants comprising single amino acid substitutions with detuned affinity to human IL-21R measured in each of several pH conditions are provided in Table 1.

In some embodiments, the cytokine variants and the receptor or receptor variants are full-length proteins. In some embodiments, the cytokine variants and the receptor or receptor variants are truncated proteins. In some embodiments, the cytokine variants and the receptor or receptor variants are fusion proteins. In some embodiments, the cytokine variants and the receptor or receptor variants are tagged proteins. Tagged proteins include proteins that are epitope tagged, e.g., FLAG-tagged, HA-tagged, His-tagged, Myc-tagged, among others known in the art. The cytokine variants and the receptor or receptor variants can each be any of the following: a full-length protein, truncated protein, fusion protein, tagged protein, or combinations thereof.

In some embodiments, surface expression of each displayed IL-21 variant is measured to select for higher expressing variants to ensure that displayed variant proteins are folded, functional variants and not poorly displayed proteins. In some embodiments, the library of cytokine variants is labeled with a FITC-conjugated anti-HA antibody. Labeled cells are then sorted by FACS into one of three bins—low (bin 1), medium (bin 2), or high (bin 3)—based on fluorescence intensity.

In some embodiments, the methods for measuring the affinity of a cytokine and its receptor include bio-layer interferometry (BLI). BLI measures kinetics and biomolecular interactions on a basis of wave interference. To prepare for BLI analysis between two unique biomolecules, the ligand is first immobilized onto a biocompatible biosensor while the analyte is in solution. After this, the biosensor tip is dipped into the solution and the target molecule will begin to associate with the analyte, producing a layer on top of the biosensor tip. This creates two separate surfaces: the substrate itself, and the substrate interacting with the molecule immobilized on the biosensor tip. This can create a thin-film interference, in which the created layer acts as a thin film bound by these two surfaces. White light from a tungsten lamp is shone onto the biosensor tip and reflected off both surfaces, creating two unique reflection patterns with different intensities.

In some cases, it is possible that cytokine variants, e.g., IL-21 variants, are measured by various affinity determination methods, e.g., AlphaSeq™ and/or BLI to have no detectable or measurable binding to the cytokine's receptor, e.g., IL-21R, while still inducing signaling in cells in vitro or in vivo. In such cases, a cytokine variant exhibiting no binding to its receptor as measured by AlphaSeq™ or BLI, or a fusion protein comprising the cytokine variant, may still have some therapeutic efficacy.

IL-21 Variants

IL-21 variants (e.g., human IL-21 variants) as described herein have decreased or no binding to the IL-21R receptor and/or reduced interaction between IL-21 and the IL-21R receptor, as compared to the wild-type human IL-21 polypeptide, e.g., as described in further detail in the Examples section. The IL-21 variants provided herein are recited in Tables 1-3 (below) as including amino acid substitutions numbered according to the wild-type sequence of human IL-21 and mouse IL-21, respectively. The wild-type amino acid sequence of human IL-21 is provided as SEQ ID NO: 1 below:

(SEQ ID NO: 1)
MRSSPGNMERIVICLMVIFLGTLVHKSSSQGQDRHMIRMRQLIDI

VDQLKNYVNDLVPEFLPAPEDVETNCEWSAFSCFQKAQLKSANTG

NNERIINVSIKKLKRKPPSTNAGRRQKHRLTCPSCDSYEKKPPKE

FLERFKSLLQKMIHQHLSSRTHGSEDS

For example, a variant with the name "IL-21_Y52D" has an amino acid substitution in SEQ ID NO: 1 at location 52, where the existing tyrosine is replaced with aspartic acid.

IL-21 has a four-helix bundle structure and exists as a monomer. In humans, two isoforms of IL-21 are known, each of which are derived from a precursor molecule. The first IL-21 isoform comprises 162 amino acids (aa), the first 29 of which make up the signal peptide; and the second IL-21 isoform comprises 153 aa, the first 29 of which make up the signal peptide as in the first isoform. IL-21 as disclosed herein are numbered according to the full-length first isoform including the signal peptide, i.e., an 162 aa polypeptide.

Tables 1 and 3 also recite affinities between IL-21 and IL-21R as measured by AlphaSeq™ (in nM). The amino acid sequence of wild-type human IL-21R is provided as SEQ ID NO: 2 below:

(SEQ ID NO: 2)
MPRGWAAPLLLLLLQGGWGCPDLVCYTDYLQTVICILEMWNLHPS

TLTLTWQDQYEELKDEATSCSLHRSAHNATHATYTCHMDVFHFMA

-continued

```
DDIFSVNITDQSGNYSQECGSFLLAESIKPAPPENVTVTFSGQYN

ISWRSDYEDPAFYMLKGKLQYELQYRNRGDPWAVSPRRKLISVDS

RSVSLLPLEFRKDSSYELQVRAGPMPGSSYQGTWSEWSDPVIFQT

QSEELKEGWNPHLLLLLLLVIVFIPAFWSLKTHPLWRLWKKIWAV

PSPERFFMPLYKGCSGDFKKWVGAPFTGSSLELGPWSPEVPSTLE

VYSCHPPRSPAKRLQLTELQEPAELVESDGVPKPSFWPTAQNSGG

SAYSEERDRPYGLVSIDTVTVLDAEGPCTWPCSCEDDGYPALDLD

AGLEPSPGLEDPLLDAGTTVLSCGCVSAGSPGLGGPLGSLLDRLK

PPLADGEDWAGGLPWGGRSPGGVSESEAGSPLAGLDMDTFDSGFV

GSDCSSPVECDFTSPGDEGPPRSYLRQWVVIPPPLSSPGPQAS
```

In some embodiments, provided herein are variants of mouse IL-21 that have decreased or no binding to the mouse IL-21R receptor and/or reduced interaction between mouse IL-21 and the mouse IL-21R receptor, as compared to the wild-type mouse IL-21 polypeptide, as described in further detail in the Examples section. The amino acid sequence of wild-type mouse IL-21 is provided as SEQ ID NO: 3 below:

```
                                        (SEQ ID NO: 3)
MERTLVCLVVIFLGTVAHKSSPQGPDRLLIRLRHLIDIVEQLKIY

ENDLDPELLSAPQDVKGHCEHAAFACFQKAKLKPSNPGNNKTFII

DLVAQLRRRLPARRGGKKQKHIAKCPSCDSYEKRTPKEFLERLKW

LLQKMIHQHLS
```

The amino acid sequence of wild-type mouse IL-21R is provided as SEQ ID NO: 4 below:

```
                                        (SEQ ID NO: 4)
MPRGPVAALLLLILHGAWSCLDLTCYTDYLWTITCVLETRSPNPS

ILSLTWQDEYEELQDQETFCSLHRSGHNTTHIWYTCHMRLSQFLS

DEVFIVNVTDQSGNNSQECGSFVLAESIKPAPPLNVTVAFSGRYD

ISWDSAYDEPSNYVLRGKLQYELQYRNLRDPYAVRPVTKLISVDS

RNVSLLPEEFHKDSSYQLQVRAAPQPGTSFRGTWSEWSDPVIFQT

QAGEPEAGWDPHMLLLLAVLIIVLVEMGLKIHLPWRLWKKIWAPV

PTPESFFQPLYREHSGNFKKWVNTPFTASSIELVPQSSTTTSALH

LSLYPAKEKKFPGLPGLEEQLECDGMSEPGHWCIIPLAAGQAVSA

YSEERDRPYGLVSIDTVTVGDAEGLCVWPCSCEDDGYPAMNLDAG

RESGPNSEDLLLVTDPAFLSCGCVSGSGLRIGGSPGSLLDRLRLS

FAKEGDWTADPTWRTGSPGGGSESEAGSPPGLDMDTFDSGFAGSD

CGSPVETDEGPPRSYLRQWVVRTPPPVDSGAQSS
```

Table 1 below discloses 273 human IL-21 variants comprising single amino acid substitutions, with the single amino acid substitutions occurring at locations throughout the length of the wild-type human IL-21 polypeptide (SEQ ID NO: 1) with reduced affinity for human IL-21R (SEQ ID NO: 2). Any variant found to bind human IL-21R with a half-log weaker affinity than wild-type human IL-21 as measured by AlphaSeq™ (cutoff=2.0 μM in unbuffered media, 56 nM in pH 7 media, 41 nM in pH 6 media, and 94 nM in pH 5 media) and found to have an average expression bin >2.25 is included in Table 1. Table 1 is sorted in order of descending $K_d$ in the unbuffered condition, with the highest values representing the lowest affinity of human IL-21 for human IL-21R.

TABLE 1

IL-21 Variants Comprising Single Amino Acid Substitutions with Detuned Affinity to Human IL21R

| Variant | Average expression bin | Affinity, pH 5 (nM) | Affinity, pH 6 (nM) | Affinity, pH 7 (nM) | Affinity, unbuffered (nM) |
|---|---|---|---|---|---|
| IL-21_Y52D | 2.46 | 3.8E+05 | 2.2E+03 | 6.1E+02 | 1.3E+06 |
| IL-21_V46Q | 2.47 | 4.0E+05 | 2.6E+05 | 7.1E+04 | 1.0E+06 |
| IL-21_W73K | 2.5 | 2.0E+05 | 3.0E+04 | 1.0E+04 | 8.9E+05 |
| IL-21_M39K | 2.9 | 1.9E+05 | 1.3E+04 | 2.2E+04 | 8.9E+05 |
| IL-21_M39D | 2.41 | 2.8E+05 | 7.6E+04 | NA | 8.0E+05 |
| IL-21_A75N | 2.47 | 2.1E+05 | 2.8E+04 | NA | 7.8E+05 |
| IL-21_V46K | 2.5 | 3.4E+05 | NA | 2.8E+04 | 7.3E+05 |
| IL-21_L56S | 2.68 | 3.1E+05 | 4.6E+04 | 4.4E+04 | 6.8E+05 |
| IL-21_Q80D | 2.32 | 5.8E+05 | NA | NA | 6.6E+05 |
| IL-21_V46T | 2.44 | 2.2E+04 | 7.1E+01 | 5.3E+01 | 6.4E+05 |
| IL-21_V57H | 2.55 | 1.6E+03 | 2.4E+01 | 1.9E+01 | 6.1E+05 |
| IL-21_F76Q | 2.25 | 3.1E+05 | 5.0E+04 | 6.3E+04 | 6.1E+05 |
| IL-21_M39Q | 2.36 | 2.2E+05 | 8.3E+04 | NA | 6.1E+05 |
| IL-21_D44P | 2.39 | 2.0E+05 | 7.3E+03 | 1.8E+03 | 5.9E+05 |
| IL-21_L103E | 2.32 | 2.4E+05 | 9.2E+04 | NA | 5.9E+05 |
| IL-21_I96D | 2.41 | 3.9E+05 | 6.0E+04 | 3.5E+04 | 5.8E+05 |
| IL-21_V53N | 2.34 | 1.8E+05 | 3.7E+03 | 9.9E+02 | 5.6E+05 |
| IL-21_L42H | 2.47 | 2.2E+05 | 6.7E+04 | 5.4E+03 | 5.5E+05 |
| IL-21_LA9E | 2.47 | 6.0E+05 | NA | NA | 5.4E+05 |
| IL-21_D47P | 2.27 | 1.3E+05 | 2.7E+04 | NA | 5.3E+05 |
| IL-21_I100E | 2.41 | 1.2E+05 | 7.8E+04 | NA | 5.1E+05 |
| IL-21_V46N | 2.41 | 3.7E+05 | 3.7E+04 | NA | 5.1E+05 |
| IL-21_R105Q | 2.37 | 2.0E+05 | NA | NA | 4.9E+05 |
| IL-21_V46G | 2.47 | 4.3E+05 | NA | NA | 4.9E+05 |
| IL-21_F76P | 2.31 | 2.5E+05 | 4.1E+04 | 3.8E+04 | 4.8E+05 |
| IL-21_W73V | 2.26 | 1.1E+05 | 6.5E+03 | 9.2E+02 | 4.8E+05 |
| IL-21_I43P | 2.54 | 3.3E+05 | 6.1E+04 | NA | 4.7E+05 |
| IL-21_Q80A | 2.25 | 2.1E+05 | 1.2E+04 | 2.4E+04 | 4.6E+05 |
| IL-21_R105D | 2.39 | 1.7E+05 | NA | NA | 4.6E+05 |
| IL-21_F76H | 2.26 | 7.9E+04 | 1.4E+04 | 9.2E+03 | 4.6E+05 |
| IL-21_LA2E | 2.56 | 1.9E+05 | NA | 2.6E+04 | 4.5E+05 |
| IL-21_W73T | 2.43 | 1.3E+05 | 4.1E+03 | 7.9E+02 | 4.5E+05 |
| IL-21_F79P | 2.36 | 1.3E+05 | 7.8E+03 | 3.3E+03 | 4.4E+05 |
| IL-21_LA2G | 2.44 | 2.1E+05 | 3.2E+04 | 2.4E+04 | 4.2E+05 |
| IL-21_I43D | 2.34 | 1.3E+05 | NA | 4.0E+03 | 4.2E+05 |
| IL-21_P108T | 2.51 | 5.7E+04 | 1.9E+03 | 1.1E+03 | 4.2E+05 |
| IL-21_Q41K | 2.6 | 1.5E+05 | NA | 7.2E+03 | 4.2E+05 |
| IL-21_LA9H | 2.34 | 1.6E+05 | NA | NA | 4.1E+05 |
| IL-21_F76R | 2.28 | 1.3E+05 | NA | NA | 4.1E+05 |
| IL-21_V46E | 2.41 | 3.5E+05 | NA | NA | 4.0E+05 |
| IL-21_R38V | 2.63 | 3.5E+05 | NA | NA | 3.8E+05 |
| IL-21_LA9D | 2.68 | 4.8E+05 | NA | NA | 3.7E+05 |
| IL-21_F76D | 2.45 | 2.2E+05 | 5.5E+04 | NA | 3.7E+05 |
| IL-21_W73S | 2.34 | 3.9E+04 | 2.3E+03 | 3.4E+02 | 3.5E+05 |
| IL-21_V57P | 2.32 | 6.8E+05 | 1.9E+04 | 3.0E+03 | 3.5E+05 |
| IL-21_M39R | 2.52 | 2.8E+05 | 1.7E+05 | NA | 3.4E+05 |
| IL-21_Y52K | 2.34 | 1.8E+05 | 2.8E+03 | 4.9E+02 | 3.4E+05 |
| IL-21_F76T | 2.26 | 7.5E+04 | NA | NA | 3.4E+05 |
| IL-21_F79Y | 2.29 | 7.2E+04 | 2.0E+03 | 5.3E+02 | 3.3E+05 |
| IL-21_M39E | 2.47 | 1.5E+05 | 4.2E+04 | NA | 3.3E+05 |
| IL-21_I45G | 2.61 | 2.0E+05 | 5.0E+03 | 1.2E+03 | 3.3E+05 |
| IL-21_D47S | 2.36 | 7.4E+05 | 4.6E+03 | 5.0E+02 | 3.3E+05 |
| IL-21_F79K | 2.29 | 7.4E+04 | 5.5E+03 | 1.8E+03 | 3.1E+05 |
| IL-21_LA9K | 2.45 | 2.0E+05 | NA | NA | 3.1E+05 |
| IL-21_L42Q | 2.35 | 3.2E+05 | 4.9E+03 | 4.6E+02 | 3.1E+05 |
| IL-21_I45H | 2.67 | 2.2E+05 | 6.2E+03 | 6.4E+02 | 3.1E+05 |
| IL-21_LA9N | 2.61 | 1.7E+05 | NA | NA | 3.0E+05 |
| IL-21_I45R | 2.55 | 3.7E+05 | 2.9E+04 | NA | 3.0E+05 |
| IL-21_I37R | 2.43 | 8.7E+02 | 1.7E+02 | 2.0E+02 | 3.0E+05 |
| IL-21_LA2N | 2.42 | 2.8E+05 | 2.6E+04 | 9.5E+02 | 3.0E+05 |
| IL-21_R105S | 2.3 | 1.3E+05 | NA | NA | 3.0E+05 |
| IL-21_I43S | 2.48 | 4.3E+04 | 1.1E+03 | 2.9E+02 | 3.0E+05 |
| IL-21_LA9P | 2.64 | 3.3E+05 | 5.5E+04 | NA | 2.9E+05 |
| IL-21_I95P | 2.32 | 6.4E+04 | 3.6E+03 | 7.0E+02 | 2.9E+05 |

TABLE 1-continued

IL-21 Variants Comprising Single Amino Acid Substitutions with Detuned Affinity to Human IL21R

| Variant | Average expres-sion bin | Affinity, pH 5 (nM) | Affinity, pH 6 (nM) | Affinity, pH 7 (nM) | Affinity, unbuffered (nM) |
|---|---|---|---|---|---|
| IL-21_R38A | 2.32 | 1.5E+04 | 1.7E+03 | NA | 2.8E+05 |
| IL-21_I45S | 2.74 | 1.5E+04 | 1.1E+02 | 1.6E+02 | 2.8E+05 |
| IL-21_R105W | 2.34 | 3.2E+05 | NA | NA | 2.8E+05 |
| IL-21_V46P | 2.5 | 5.1E+05 | NA | NA | 2.8E+05 |
| IL-21_I45Y | 2.34 | 2.0E+05 | 1.2E+04 | 3.8E+03 | 2.8E+05 |
| IL-21_R38Q | 2.25 | 1.4E+05 | 1.2E+04 | 4.2E+03 | 2.7E+05 |
| IL-21_I96P | 2.27 | 1.4E+05 | 5.7E+03 | 3.0E+03 | 2.7E+05 |
| IL-21_F76E | 2.26 | 1.0E+05 | 6.9E+03 | 2.4E+04 | 2.7E+05 |
| IL-21_R105A | 2.38 | 2.6E+05 | NA | 2.0E+04 | 2.7E+05 |
| IL-21_V46D | 2.71 | 8.6E+04 | 1.2E+04 | NA | 2.7E+05 |
| IL-21_V53P | 2.26 | 2.7E+05 | 2.7E+04 | 4.0E+03 | 2.7E+05 |
| IL-21_M39P | 2.7 | NA | NA | NA | 2.6E+05 |
| IL-21_I95K | 2.38 | 1.9E+04 | 6.8E+02 | 2.4E+02 | 2.6E+05 |
| IL-21_LA2K | 2.47 | 1.3E+05 | NA | 1.2E+04 | 2.5E+05 |
| IL-21_R105K | 2.53 | 1.3E+05 | 6.2E+02 | 2.2E+02 | 2.5E+05 |
| IL-21_R38K | 2.36 | 2.3E+05 | 1.8E+03 | 7.0E+03 | 2.5E+05 |
| IL-21_M39G | 2.34 | 1.5E+05 | 3.1E+04 | 7.8E+03 | 2.4E+05 |
| IL-21_L56F | 2.28 | 5.4E+04 | 7.1E+02 | 2.4E+02 | 2.4E+05 |
| IL-21_I37S | 2.41 | 1.6E+04 | 5.3E+02 | 3.2E+02 | 2.4E+05 |
| IL-21_D44A | 2.34 | 1.4E+02 | 5.2E+01 | 2.4E+02 | 2.4E+05 |
| IL-21_I37N | 2.27 | 3.3E+04 | 6.8E+02 | 3.3E+02 | 2.3E+05 |
| IL-21_I96T | 2.26 | 2.1E+05 | 6.6E+04 | NA | 2.2E+05 |
| IL-21_L56N | 2.42 | 7.2E+04 | NA | 9.7E+03 | 2.1E+05 |
| IL-21_I45P | 2.67 | 1.0E+05 | NA | NA | 2.1E+05 |
| IL-21_I96G | 2.44 | 1.9E+05 | 5.2E+04 | NA | 2.1E+05 |
| IL-21_E59R | 2.28 | 4.1E+04 | 1.5E+03 | 3.4E+02 | 2.1E+05 |
| IL-21_Q41P | 2.35 | 1.8E+05 | 3.5E+04 | NA | 2.0E+05 |
| IL-21_I45D | 2.54 | 2.0E+04 | 1.9E+02 | 1.8E+02 | 1.9E+05 |
| IL-21_P108Q | 2.29 | 3.8E+03 | 3.0E+02 | 1.1E+02 | 1.9E+05 |
| IL-21_LA9S | 2.4 | 2.4E+05 | NA | NA | 1.9E+05 |
| IL-21_LA2D | 2.5 | 1.6E+06 | 1.4E+04 | 3.7E+03 | 1.9E+05 |
| IL-21_LA2S | 2.46 | 1.8E+05 | NA | 1.1E+04 | 1.9E+05 |
| IL-21_Q48K | 2.41 | 1.1E+04 | 2.0E+02 | 2.2E+02 | 1.9E+05 |
| IL-21_F79T | 2.28 | 9.2E+04 | 3.3E+03 | 1.4E+03 | 1.8E+05 |
| IL-21_I45N | 2.52 | 3.2E+05 | 3.8E+03 | 1.0E+03 | 1.8E+05 |
| IL-21_W73P | 2.59 | 4.4E+05 | 8.7E+03 | 7.3E+02 | 1.8E+05 |
| IL-21_D44G | 2.46 | 4.8E+02 | 5.0E+01 | 2.0E+02 | 1.8E+05 |
| IL-21_L120V | 2.68 | 1.2E+03 | 2.1E+02 | 2.1E+02 | 1.8E+05 |
| IL-21_I148S | 2.34 | 3.1E+02 | 4.2E+01 | 2.9E+02 | 1.7E+05 |
| IL-21_F79D | 2.32 | 5.2E+04 | 2.7E+03 | 6.4E+02 | 1.7E+05 |
| IL-21_I37G | 2.31 | 8.2E+04 | 8.6E+02 | 6.6E+02 | 1.7E+05 |
| IL-21_LA9R | 2.57 | 3.9E+05 | NA | NA | 1.6E+05 |
| IL-21_I96A | 2.44 | 4.2E+05 | 1.1E+04 | NA | 1.6E+05 |
| IL-21_I95H | 2.32 | 5.3E+04 | 2.0E+03 | 5.8E+02 | 1.5E+05 |
| IL-21_W73G | 2.41 | 5.7E+04 | 2.2E+03 | 3.3E+02 | 1.5E+05 |
| IL-21_V98K | 2.59 | 4.9E+02 | 9.4E+01 | 2.5E+02 | 1.5E+05 |
| IL-21_V53Q | 2.55 | 1.8E+04 | 1.6E+02 | 2.0E+02 | 1.4E+05 |
| IL-21_P108G | 2.44 | 1.1E+04 | 7.9E+02 | 4.7E+02 | 1.4E+05 |
| IL-21_D33P | 2.47 | 4.0E+04 | 7.7E+02 | 2.7E+02 | 1.3E+05 |
| IL-21_F79R | 2.33 | 6.5E+04 | 4.4E+03 | 4.5E+03 | 1.3E+05 |
| IL-21_W73N | 2.34 | 6.5E+04 | 3.4E+03 | 8.5E+02 | 1.2E+05 |
| IL-21_I96S | 2.35 | 4.6E+05 | 1.3E+04 | NA | 1.2E+05 |
| IL-21_R38M | 2.38 | 8.8E+02 | 1.2E+03 | 2.0E+03 | 1.2E+05 |
| IL-21_V98R | 2.52 | 4.6E+01 | 1.9E+01 | 2.8E+01 | 1.2E+05 |
| IL-21_P132A | 2.29 | 4.7E+02 | 2.4E+01 | 1.2E+02 | 1.2E+05 |
| IL-21_LA2R | 2.43 | 1.5E+05 | NA | NA | 1.2E+05 |
| IL-21_D33R | 2.69 | 2.6E+04 | 8.1E+02 | 1.4E+02 | 1.2E+05 |
| IL-21_Y52N | 2.7 | 2.4E+04 | 3.8E+02 | 2.4E+02 | 1.1E+05 |
| IL-21_L56E | 2.25 | 1.2E+06 | 3.0E+04 | NA | 1.1E+05 |
| IL-21_I37E | 2.61 | 1.5E+03 | 5.5E+02 | 7.2E+02 | 1.1E+05 |
| IL-21_R38E | 2.62 | NA | 8.4E+03 | NA | 1.1E+05 |
| IL-21_F79E | 2.35 | 5.9E+04 | 7.0E+03 | 6.9E+03 | 1.1E+05 |
| IL-21_P62V | 2.3 | 1.1E+04 | 2.7E+02 | 1.2E+02 | 1.1E+05 |
| IL-21_L56T | 2.6 | 2.3E+05 | 6.9E+03 | NA | 1.0E+05 |
| IL-21_I37K | 2.61 | 3.3E+03 | 1.9E+02 | 1.2E+02 | 9.5E+04 |
| IL-21_S74H | 2.51 | 1.7E+02 | 2.6E+01 | 3.1E+01 | 8.5E+04 |
| IL-21_Y52H | 2.51 | 4.4E+03 | 2.9E+02 | 1.1E+02 | 6.9E+04 |
| IL-21_D44T | 2.51 | 3.5E+02 | 4.4E+01 | 1.6E+02 | 6.8E+04 |
| IL-21_Y52Q | 2.42 | 5.5E+04 | 3.9E+02 | 8.9E+01 | 6.3E+04 |
| IL-21_D44N | 2.28 | 1.2E+03 | 9.2E+01 | 2.9E+02 | 6.0E+04 |
| IL-21_S99H | 2.35 | 3.7E+03 | 3.2E+01 | 2.5E+01 | 6.0E+04 |
| IL-21_V53H | 2.62 | 2.2E+03 | 3.8E+01 | 3.8E+01 | 4.6E+04 |
| IL-21_S77R | 2.55 | 1.9E+01 | 1.2E+01 | 3.2E+01 | 4.6E+04 |

TABLE 1-continued

IL-21 Variants Comprising Single Amino Acid Substitutions with Detuned Affinity to Human IL21R

| Variant | Average expres-sion bin | Affinity, pH 5 (nM) | Affinity, pH 6 (nM) | Affinity, pH 7 (nM) | Affinity, unbuffered (nM) |
|---|---|---|---|---|---|
| IL-21_S109K | 2.25 | 4.3E+01 | 2.6E+01 | 3.0E+01 | 4.0E+04 |
| IL-21_I95T | 2.48 | 9.8E+03 | 5.5E+02 | 1.9E+02 | 3.4E+04 |
| IL-21_W73L | 2.38 | 5.2E+03 | 2.0E+02 | 1.3E+02 | 3.3E+04 |
| IL-21_S74N | 2.3. | 4.8E+04 | 2.9E+02 | 4.1E+02 | 3.2E+04 |
| IL-21_Q145H | 2.27 | 1.0E+03 | 5.4E+01 | 6.8E+01 | 3.2E+04 |
| IL-21_V53E | 2.72 | 1.8E+02 | 2.2E+01 | 1.9E+01 | 3.1E+04 |
| IL-21_V53T | 2.84 | 9.6E+03 | 6.3E+01 | 1.8E+02 | 3.0E+04 |
| IL-21_K131M | 2.34 | 4.6E+02 | 6.9E+01 | 8.6E+01 | 2.7E+04 |
| IL-21_W73A | 2.37 | 3.5E+03 | 3.6E+02 | 1.7E+02 | 2.6E+04 |
| IL-21_R34S | 2.29 | 3.8E+03 | 3.0E+02 | 2.7E+02 | 2.3E+04 |
| IL-21_L120H | 2.56 | 3.4E+01 | 1.9E+01 | 3.0E+01 | 2.2E+04 |
| IL-21_N88K | 2.28 | 1.7E+02 | 4.3E+01 | 1.4E+02 | 2.1E+04 |
| IL-21_R34W | 2.47 | 6.6E+02 | 9.6E+01 | 1.9E+02 | 2.0E+04 |
| IL-21_D33A | 2.41 | 5.8E+02 | 3.8E+01 | 8.3E+01 | 1.9E+04 |
| IL-21_L61I | 2.38 | 3.7E+02 | 3.7E+01 | 8.3E+01 | 1.9E+04 |
| IL-21_I37Q | 2.65 | 2.5E+02 | 3.5E+01 | 1.4E+02 | 1.9E+04 |
| IL-21_R34D | 2.58 | 2.3E+04 | 8.6E+02 | 7.4E+02 | 1.8E+04 |
| IL-21_T89L | 2.51 | 1.0E+03 | 1.1E+02 | 1.4E+02 | 1.6E+04 |
| IL-21_D33T | 2.25 | 1.3E+02 | 3.8E+01 | 2.2E+02 | 1.5E+04 |
| IL-21_W73Q | 2.37 | 6.7E+02 | 8.8E+01 | 1.2E+02 | 1.5E+04 |
| IL-21_S77K | 2.29 | 1.9E+02 | 1.3E+02 | 1.7E+02 | 1.4E+04 |
| IL-21_R34K | 2.42 | 3.9E+02 | 4.7E+01 | 7.4E+01 | 1.4E+04 |
| IL-21_D33N | 2.32 | 1.2E+02 | 2.7E+01 | 4.5E+01 | 1.4E+04 |
| IL-21_V57R | 2.49 | 5.0E+01 | 1.6E+01 | 5.0E+01 | 1.4E+04 |
| IL-21_Q150R | 2.34 | 1.8E+02 | 5.0E+01 | 9.4E+01 | 1.4E+04 |
| IL-21_D33S | 2.52 | 8.2E+01 | 1.9E+01 | 2.7E+01 | 1.3E+04 |
| IL-21_E72S | 2.39 | 5.3E+02 | 1.4E+02 | 3.4E+02 | 1.3E+04 |
| IL-21_H118R | 2.37 | 2.0E+04 | 9.5E+02 | 2.6E+02 | 1.1E+04 |
| IL-21_S142H | 2.39 | 5.1E+01 | 1.9E+01 | 3.8E+01 | 1.1E+04 |
| IL-21_R34H | 2.51 | 1.9E+03 | 6.9E+01 | 2.0E+02 | 1.0E+04 |
| IL-21_R34G | 2.69 | 6.4E+03 | 1.5E+02 | 1.8E+02 | 9.9E+03 |
| IL-21_V98H | 2.52 | 1.7E+02 | 2.6E+01 | 2.2E+01 | 8.8E+03 |
| IL-21_L120K | 2.48 | 4.7E+01 | 2.5E+01 | 4.6E+01 | 8.7E+03 |
| IL-21_N51P | 2.63 | 1.6E+02 | 2.4E+01 | 4.7E+01 | 8.5E+03 |
| IL-21_I45A | 2.65 | 1.8E+02 | 2.5E+01 | 6.1E+01 | 8.4E+03 |
| IL-21_P108L | 2.26 | 3.6E+02 | 3.5E+01 | 9.9E+01 | 8.1E+03 |
| IL-21_N54K | 2.28 | 1.9E+02 | 2.9E+01 | 3.2E+01 | 8.0E+03 |
| IL-21_A112R | 2.36 | 3.9E+01 | 1.9E+01 | 3.1E+01 | 7.9E+03 |
| IL-21_F60I | 2.44 | 3.4E+02 | 6.4E+01 | 1.9E+02 | 7.7E+03 |
| IL-21_N97G | 2.26 | 7.7E+01 | 2.4E+01 | 4.8E+01 | 7.6E+03 |
| IL-21_D33Q | 2.45 | 8.4E+01 | 2.1E+01 | 1.9E+01 | 7.5E+03 |
| IL-21_E93G | 2.36 | 7.3E+01 | 3.7E+01 | 1.5E+02 | 7.2E+03 |
| IL-21_H118K | 2.33 | 9.9E+04 | 3.1E+03 | 3.7E+02 | 6.8E+03 |
| IL-21_L56M | 2.44 | 3.5E+02 | 4.5E+01 | 8.4E+01 | 6.7E+03 |
| IL-21_P107Y | 2.49 | 1.2E+02 | 5.8E+01 | 2.2E+02 | 6.5E+03 |
| IL-21_E68R | 2.32 | 4.0E+01 | 1.6E+01 | 6.9E+01 | 6.3E+03 |
| IL-21_S109R | 2.32 | 3.6E+01 | 1.5E+01 | 1.4E+01 | 6.0E+03 |
| IL-21_N54P | 2.47 | 8.9E+01 | 2.0E+01 | 2.7E+01 | 5.4E+03 |
| IL-21_P62H | 2.43 | 1.6E+02 | 2.1E+01 | 1.1E+02 | 5.1E+03 |
| IL-21_E59S | 2.27 | 4.1E+01 | 1.6E+01 | 2.3E+01 | 4.9E+03 |
| IL-21_E72I | 2.5 | 4.2E+01 | 1.5E+01 | 1.3E+02 | 4.7E+03 |
| IL-21_P62T | 2.31 | 1.3E+02 | 2.8E+01 | 4.6E+01 | 4.5E+03 |
| IL-21_L152H | 2.47 | 2.6E+01 | 1.2E+01 | 3.0E+01 | 4.4E+03 |
| IL-21_S74A | 2.51 | 1.4E+02 | 3.8E+01 | 1.6E+02 | 4.4E+03 |
| IL-21_N70H | 2.26 | 6.4E+01 | 2.0E+01 | 2.2E+01 | 4.4E+03 |
| IL-21_F76M | 2.39 | 7.7E+01 | 2.1E+01 | 7.5E+01 | 4.3E+03 |
| IL-21_S86I | 2.42 | 1.1E+02 | 2.3E+01 | 5.2E+01 | 4.3E+03 |
| IL-21_F60R | 2.35 | 7.6E+01 | 2.6E+01 | 2.7E+01 | 4.2E+03 |
| IL-21_P108I | 2.36 | 1.8E+02 | 6.1E+01 | 7.1E+01 | 4.2E+03 |
| IL-21_N54H | 2.37 | 7.7E+01 | 2.0E+01 | 2.7E+01 | 4.1E+03 |
| IL-21_R34E | 2.63 | 8.7E+03 | 5.0E+02 | 2.1E+02 | 4.0E+03 |
| IL-21_A87N | 2.43 | 1.1E+02 | 2.5E+01 | 1.2E+02 | 3.9E+03 |
| IL-21_W73Y | 2.39 | 1.9E+02 | 8.5E+01 | 6.8E+01 | 3.7E+03 |
| IL-21_I43M | 2.3 | 1.1E+02 | 2.7E+01 | 4.9E+01 | 3.5E+03 |
| IL-21_E72H | 2.36 | 2.8E+01 | 1.1E+01 | 2.1E+01 | 3.4E+03 |
| IL-21_R34Y | 2.36 | 6.7E+03 | 3.5E+02 | 2.7E+02 | 3.4E+03 |
| IL-21_A63T | 2.54 | 6.4E+01 | 2.1E+01 | 2.1E+02 | 3.3E+03 |
| IL-21_E68K | 2.27 | 2.7E+01 | 1.4E+01 | 2.2E+01 | 3.3E+03 |
| IL-21_Q48G | 2.52 | 5.9E+01 | 1.6E+01 | 3.9E+01 | 3.2E+03 |
| IL-21_I37V | 2.64 | 5.8E+01 | 1.8E+01 | 3.1E+01 | 3.2E+03 |
| IL-21_M36T | 2.27 | 1.1E+02 | 2.8E+01 | 6.7E+01 | 3.1E+03 |
| IL-21_Q41S | 2.47 | 1.4E+02 | 2.6E+01 | 2.5E+01 | 3.0E+03 |
| IL-21_R139S | 2.45 | 8.1E+01 | 2.2E+01 | 2.3E+02 | 3.0E+03 |

TABLE 1-continued

IL-21 Variants Comprising Single Amino Acid Substitutions with Detuned Affinity to Human IL21R

| Variant | Average expres-sion bin | Affinity, pH 5 (nM) | Affinity, pH 6 (nM) | Affinity, pH 7 (nM) | Affinity, unbuffered (nM) |
|---|---|---|---|---|---|
| IL-21_I96V | 2.32 | 1.9E+02 | 3.2E+01 | 6.2E+01 | 3.0E+03 |
| IL-21_P133I | 2.3 | 1.8E+02 | 4.4E+01 | 1.1E+02 | 2.9E+03 |
| IL-21_E72T | 2.6 | 6.7E+01 | 2.7E+01 | 5.7E+01 | 2.8E+03 |
| IL-21_P108E | 2.32 | 1.9E+04 | 9.2E+02 | 5.5E+02 | 2.8E+03 |
| IL-21_P62S | 2.47 | 1.0E+02 | 1.9E+01 | 2.7E+01 | 2.8E+03 |
| IL-21_Q32K | 2.6 | 2.7E+01 | 1.2E+01 | 2.8E+01 | 2.7E+03 |
| IL-21_D66R | 2.42 | 2.5E+01 | 1.3E+01 | 1.3E+01 | 2.7E+03 |
| IL-21_V57L | 2.3 | 7.3E+01 | 2.2E+01 | 8.8E+01 | 2.7E+03 |
| IL-21_R34P | 2.54 | 1.4E+03 | 7.6E+02 | 4.2E+02 | 2.7E+03 |
| IL-21_S142I | 2.43 | 6.3E+01 | 2.8E+01 | 4.1E+01 | 2.6E+03 |
| IL-21_S109M | 2.51 | 7.2E+01 | 4.3E+02 | 8.1E+01 | 2.5E+03 |
| IL-21_M39I | 2.28 | 1.3E+02 | 3.0E+01 | 3.5E+01 | 2.5E+03 |
| IL-21_N51V | 2.3 | 4.6E+02 | 6.2E+01 | 2.9E+02 | 2.5E+03 |
| IL-21_E93T | 2.6 | 4.6E+01 | 1.3E+01 | 6.6E+01 | 2.4E+03 |
| IL-21_F60H | 2.64 | 6.2E+01 | 1.5E+01 | 3.5E+01 | 2.4E+03 |
| IL-21_N51G | 2.49 | 1.1E+02 | 3.0E+01 | 4.4E+01 | 2.3E+03 |
| IL-21_V57T | 2.41 | 1.7E+02 | 1.3E+02 | 7.8E+01 | 2.3E+03 |
| IL-21_V57M | 2.3 | 5.7E+01 | 2.2E+01 | 2.5E+01 | 2.3E+03 |
| IL-21_L61H | 2.42 | 1.2E+02 | 2.3E+01 | 2.4E+01 | 2.2E+03 |
| IL-21_LA2Y | 2.35 | 4.3E+01 | 1.1E+01 | 2.1E+01 | 2.1E+03 |
| IL-21_D66M | 2.3 | 5.5E+01 | 1.9E+01 | 2.6E+01 | 2.1E+03 |
| IL-21_R34N | 2.54 | 9.6E+02 | 5.2E+01 | 1.3E+02 | 2.1E+03 |
| IL-21_R34F | 2.47 | 3.9E+02 | 5.2E+01 | 1.1E+02 | 2.1E+03 |
| IL-21_V57Y | 2.43 | 4.6E+01 | 1.6E+01 | 1.7E+01 | 2.1E+03 |
| IL-21_K104G | 2.27 | 4.7E+02 | 7.9E+01 | 1.3E+02 | 1.9E+03 |
| IL-21_H151E | 2.48 | 2.9E+02 | 8.2E+02 | 3.0E+02 | 1.7E+03 |
| IL-21_L120M | 2.29 | 5.2E+01 | 3.6E+01 | 5.6E+01 | 1.7E+03 |
| IL-21_K106S | 2.5 | 7.3E+03 | 6.5E+02 | 1.3E+03 | 1.7E+03 |
| IL-21_E72L | 2.31 | 4.7E+01 | 5.2E+02 | 1.6E+02 | 1.7E+03 |
| IL-21_I43L | 2.31 | 5.8E+01 | 2.0E+01 | 6.1E+01 | 1.5E+03 |
| IL-21_P108D | 2.38 | 1.9E+04 | 5.9E+02 | 2.4E+02 | 1.4E+03 |
| IL-21_V53S | 2.77 | 4.7E+01 | 2.0E+01 | 5.6E+01 | 1.4E+03 |
| IL-21_R34Q | 2.51 | 2.0E+02 | 3.5E+01 | 1.2E+02 | 1.1E+03 |
| IL-21_V53A | 2.38 | 3.2E+01 | 1.7E+01 | 5.6E+01 | 1.1E+03 |
| IL-21_K106N | 2.48 | 1.0E+04 | 5.5E+02 | 6.5E+02 | 1.0E+03 |

TABLE 1-continued

IL-21 Variants Comprising Single Amino Acid Substitutions with Detuned Affinity to Human IL21R

| Variant | Average expres-sion bin | Affinity, pH 5 (nM) | Affinity, pH 6 (nM) | Affinity, pH 7 (nM) | Affinity, unbuffered (nM) |
|---|---|---|---|---|---|
| IL-21_A112P | 2.28 | 5.8E+01 | 2.1E+01 | 8.0E+01 | 1.0E+03 |
| IL-21_Q150D | 2.32 | 5.6E+01 | 2.1E+01 | 5.9E+01 | 9.6E+02 |
| IL-21_Q150S | 2.66 | 4.3E+01 | 1.8E+01 | 1.2E+02 | 8.7E+02 |
| IL-21_K106P | 2.46 | 2.9E+02 | 3.0E+01 | 6.8E+01 | 8.7E+02 |
| IL-21_R34A | 2.66 | 3.6E+02 | 3.8E+01 | 2.2E+02 | 8.6E+02 |
| IL-21_N70A | 2.26 | 3.3E+01 | 1.7E+01 | 9.4E+01 | 8.5E+02 |
| IL-21_R34V | 2.44 | 1.4E+02 | 2.7E+01 | 1.1E+02 | 8.4E+02 |
| IL-21_L120Y | 2.4 | 2.8E+01 | 1.3E+01 | 5.8E+01 | 7.9E+02 |
| IL-21_R38F | 2.48 | 4.9E+01 | 2.3E+01 | 2.9E+02 | 7.9E+02 |
| IL-21_S77M | 2.46 | 4.0E+01 | 1.5E+01 | 6.0E+01 | 7.7E+02 |
| IL-21_K85S | 2.42 | 1.5E+02 | 2.2E+01 | 3.2E+01 | 7.1E+02 |
| IL-21_R94S | 2.31 | 1.4E+02 | 2.7E+01 | 3.5E+01 | 5.7E+02 |
| IL-21_H35P | 2.4 | 4.1E+01 | 2.2E+01 | 5.9E+01 | 5.6E+02 |
| IL-21_R114F | 2.47 | 1.4E+02 | 4.8E+01 | 5.7E+01 | 4.5E+02 |
| IL-21_S142D | 2.46 | 3.8E+01 | 1.3E+01 | 6.7E+01 | 4.5E+02 |
| IL-21_R34M | 2.6 | 1.5E+02 | 2.8E+01 | 6.7E+01 | 3.9E+02 |
| IL-21_R34T | 2.58 | 1.8E+02 | 2.6E+01 | 1.4E+02 | 3.5E+02 |
| IL-21_R34L | 2.38 | 1.0E+02 | 2.2E+01 | 7.7E+01 | 3.3E+02 |
| IL-21_R94T | 2.48 | 2.1E+02 | 2.7E+01 | 8.0E+01 | 2.7E+02 |
| IL-21_R115I | 2.3 | 1.4E+02 | 3.5E+01 | 5.0E+01 | 2.6E+02 |
| IL-21_N51E | 2.51 | 2.0E+01 | 1.1E+01 | 1.4E+02 | 2.5E+02 |
| IL-21_K131V | 2.25 | 2.6E+01 | 1.3E+01 | 6.9E+01 | 2.2E+02 |
| IL-21_K106T | 2.32 | 2.0E+02 | 2.2E+02 | 2.9E+02 | 2.1E+02 |
| IL-21_P107D | 2.36 | 6.0E+01 | 2.3E+01 | 3.1E+02 | 1.9E+02 |
| IL-21_H118I | 2.35 | 3.6E+02 | 7.4E+01 | 2.9E+01 | 1.5E+02 |
| IL-21_K106E | 2.4 | 1.9E+04 | 8.5E+02 | 5.5E+02 | 1.2E+02 |
| IL-21_R115Q | 2.41 | 3.2E+01 | 1.1E+01 | 5.6E+01 | 7.4E+01 |
| IL-21_R115P | 2.32 | 4.2E+01 | 1.5E+01 | 5.7E+01 | 5.5E+01 |

Table 2 below discloses the polypeptide sequence of the 273 human IL-21 variants comprising single amino acid substitutions disclosed in Table 1, with the single amino acid substitutions occurring at locations throughout the length of the wild-type human IL-21 polypeptide (SEQ ID NO: 1).

TABLE 2

Polypeptide Sequences of Human IL-21 Variants Comprising Single Amino Acid Substitutions

| Variant | Amino Acid Sequence | SEQ ID NO |
|---|---|---|
| IL-21_Y52D | MRSSPGNMERIVICLMVIFLGTLVHKSSSQGQDRHMIRMR QLIDIVDQLKNDVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 15 |
| IL-21_V46Q | MRSSPGNMERIVICLMVIFLGTLVHKSSSQGQDRHMIRMR QLIDIQDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 16 |
| IL-21_W73K | MRSSPGNMERIVICLMVIFLGTLVHKSSSQGQDRHMIRMR QLIDIVDQLKNYVNDLVPEFLPAPEDVETNCEKSAFSCFQ KAQLKSANTGNNERIINVSIKKLKRKPPSTNAGRRQKHRL TCPSCDSYEKKPPKEFLERFKSLLQKMIHQHLSSRTHGSE DS | 17 |
| IL-21_M39K | MRSSPGNMERIVICLMVIFLGTLVHKSSSQGQDRHMIRKR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 18 |

TABLE 2-continued

Polypeptide Sequences of Human IL-21 Variants Comprising Single Amino Acid Substitutions

| Variant | Amino Acid Sequence | SEQ ID NO |
|---|---|---|
| IL-21_ M39D | MRSSPGNMERIVICLMVIFLGTLVHKSSSQGQDRHMIRDR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 19 |
| IL-21_ A75N | MRSSPGNMERIVICLMVIFLGTLVHKSSSQGQDRHMIRMR QLIDIVDQLKNYVNDLVPEFLPAPEDVETNCEWSNFSCFQ KAQLKSANTGNNERIINVSIKKLKRKPPSTNAGRRQKHRL TCPSCDSYEKKPPKEFLERFKSLLQKMIHQHLSSRTHGSE DS | 20 |
| IL-21_ V46K | MRSSPGNMERIVICLMVIFLGTLVHKSSSQGQDRHMIRMR QLIDIKDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 21 |
| IL-21_ L56S | MRSSPGNMERIVICLMVIFLGTLVHKSSSQGQDRHMIRMR QLIDIVDQLKNYVNDSVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 22 |
| IL-21_ Q80D | MRSSPGNMERIVICLMVIFLGTLVHKSSSQGQDRHMIRMR QLIDIVDQLKNYVNDLVPEFLPAPEDVETNCEWSAFSCFD KAQLKSANTGNNERIINVSIKKLKRKPPSTNAGRRQKHRL TCPSCDSYEKKPPKEFLERFKSLLQKMIHQHLSSRTHGSE DS | 23 |
| IL-21_ V46T | MRSSPGNMERIVICLMVIFLGTLVHKSSSQGQDRHMIRMR QLIDITDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 24 |
| IL-21_ V57H | MRSSPGNMERIVICLMVIFLGTLVHKSSSQGQDRHMIRMR QLIDIVDQLKNYVNDLHPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 25 |
| IL-21_ F76Q | MRSSPGNMERIVICLMVIFLGTLVHKSSSQGQDRHMIRMR QLIDIVDQLKNYVNDLVPEFLPAPEDVETNCEWSAQSCFQ KAQLKSANTGNNERIINVSIKKLKRKPPSTNAGRRQKHRL TCPSCDSYEKKPPKEFLERFKSLLQKMIHQHLSSRTHGSE DS | 26 |
| IL-21_ M39Q | MRSSPGNMERIVICLMVIFLGTLVHKSSSQGQDRHMIRQR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 27 |
| IL-21_ D44P | MRSSPGNMERIVICLMVIFLGTLVHKSSSQGQDRHMIRMR QLIPIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 28 |
| IL-21_ L103E | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKEKRKPPSTNAGRRQKHRL TCPSCDSYEKKPPKEFLERFKSLLQKMIHQHLSSRTHGSE DS | 29 |
| IL-21_ 196D | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIDNVSIKKLKRKPPSTNAGRRQKHRL TCPSCDSYEKKPPKEFLERFKSLLQKMIHQHLSSRTHGSE DS | 30 |

TABLE 2-continued

Polypeptide Sequences of Human IL-21 Variants Comprising Single Amino Acid Substitutions

| Variant | Amino Acid Sequence | SEQ ID NO |
|---|---|---|
| IL-21_ V53N | MRSSPGNMERIVICLMVIFLGTLVHKSSSQGQDRHMIRMR QLIDIVDQLKNYNNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 31 |
| IL-21_ L42H | MRSSPGNMERIVICLMVIFLGTLVHKSSSQGQDRHMIRMR QHIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 32 |
| IL-21_ L49E | MRSSPGNMERIVICLMVIFLGTLVHKSSSQGQDRHMIRMR QLIDIVDQEKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 33 |
| IL-21_ D47P | MRSSPGNMERIVICLMVIFLGTLVHKSSSQGQDRHMIRMR QLIDIVPQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 34 |
| IL-21_ 1100E | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSEKKLKRKPPSTNAGRRQKHRL TCPSCDSYEKKPPKEFLERFKSLLQKMIHQHLSSRTHGSE DS | 35 |
| IL-21_ V46N | MRSSPGNMERIVICLMVIFLGTLVHKSSSQGQDRHMIRMR QLIDINDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 36 |
| IL-21_ R105Q | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKQKPPSTNAGRRQKHRL TCPSCDSYEKKPPKEFLERFKSLLQKMIHQHLSSRTHGSE DS | 37 |
| IL-21_ V46G | MRSSPGNMERIVICLMVIFLGTLVHKSSSQGQDRHMIRMR QLIDIGDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 38 |
| IL-21_ F76P | MRSSPGNMERIVICLMVIFLGTLVHKSSSQGQDRHMIRMR QLIDIVDQLKNYVNDLVPEFLPAPEDVETNCEWSAPSCFQ KAQLKSANTGNNERIINVSIKKLKRKPPSTNAGRRQKHRL TCPSCDSYEKKPPKEFLERFKSLLQKMIHQHLSSRTHGSE DS | 39 |
| IL-21_ W73V | MRSSPGNMERIVICLMVIFLGTLVHKSSSQGQDRHMIRMR QLIDIVDQLKNYVNDLVPEFLPAPEDVETNCEVSAFSCFQ KAQLKSANTGNNERIINVSIKKLKRKPPSTNAGRRQKHRL TCPSCDSYEKKPPKEFLERFKSLLQKMIHQHLSSRTHGSE DS | 40 |
| IL-21_ 143P | MRSSPGNMERIVICLMVIFLGTLVHKSSSQGQDRHMIRMR QLPDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 41 |
| IL-21_ Q80A | MRSSPGNMERIVICLMVIFLGTLVHKSSSQGQDRHMIRMR QLIDIVDQLKNYVNDLVPEFLPAPEDVETNCEWSAFSCFA KAQLKSANTGNNERIINVSIKKLKRKPPSTNAGRRQKHRL TCPSCDSYEKKPPKEFLERFKSLLQKMIHQHLSSRTHGSE DS | 42 |

TABLE 2-continued

| Variant | Amino Acid Sequence | SEQ ID NO |
|---|---|---|
| Polypeptide Sequences of Human IL-21 Variants Comprising Single Amino Acid Substitutions | | |
| IL-21_<br>R105D | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIINVSIKKLKDKPPSTNAGRRQKHRL<br>TCPSCDSYEKKPPKEFLERFKSLLQKMIHQHLSSRTHGSE<br>DS | 43 |
| IL-21_<br>F76H | MRSSPGNMERIVICLMVIFLGTLVHKSSSQGQDRHMIRMR<br>QLIDIVDQLKNYVNDLVPEFLPAPEDVETNCEWSAHSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 44 |
| IL-21_<br>L42E | MRSSPGNMERIVICLMVIFLGTLVHKSSSQGQDRHMIRMR<br>QEIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 45 |
| IL-21_<br>W73T | MRSSPGNMERIVICLMVIFLGTLVHKSSSQGQDRHMIRMR<br>QLIDIVDQLKNYVNDLVPEFLPAPEDVETNCETSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 46 |
| IL-21_<br>F79P | MRSSPGNMERIVICLMVIFLGTLVHKSSSQGQDRHMIRMR<br>QLIDIVDQLKNYVNDLVPEFLPAPEDVETNCEWSAFSCPQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 47 |
| IL-21_<br>L42G | MRSSPGNMERIVICLMVIFLGTLVHKSSSQGQDRHMIRMR<br>QGIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 48 |
| IL-21_<br>143D | MRSSPGNMERIVICLMVIFLGTLVHKSSSQGQDRHMIRMR<br>QLDDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 49 |
| IL-21_<br>P108T | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIINVSIKKLKRKPTSTNAGRRQKHRL<br>TCPSCDSYEKKPPKEFLERFKSLLQKMIHQHLSSRTHGSE<br>DS | 50 |
| IL-21_<br>Q41K | MRSSPGNMERIVICLMVIFLGTLVHKSSSQGQDRHMIRMR<br>KLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 51 |
| IL-21_<br>L49H | MRSSPGNMERIVICLMVIFLGTLVHKSSSQGQDRHMIRMR<br>QLIDIVDQHKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 52 |
| IL-21_<br>F76R | MRSSPGNMERIVICLMVIFLGTLVHKSSSQGQDRHMIRMR<br>QLIDIVDQLKNYVNDLVPEFLPAPEDVETNCEWSARSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 53 |
| IL-21_<br>V46E | MRSSPGNMERIVICLMVIFLGTLVHKSSSQGQDRHMIRMR<br>QLIDIEDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 54 |

TABLE 2-continued

Polypeptide Sequences of Human IL-21 Variants Comprising Single Amino Acid Substitutions

| Variant | Amino Acid Sequence | SEQ ID NO |
|---|---|---|
| IL-21_ R38V | MRSSPGNMERIVICLMVIFLGTLVHKSSSQGQDRHMIVMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 55 |
| IL-21_ L49D | MRSSPGNMERIVICLMVIFLGTLVHKSSSQGQDRHMIRMR<br>QLIDIVDQDKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 56 |
| IL-21_ F76D | MRSSPGNMERIVICLMVIFLGTLVHKSSSQGQDRHMIRMR<br>QLIDIVDQLKNYVNDLVPEFLPAPEDVETNCEWSADSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 57 |
| IL-21_ W73S | MRSSPGNMERIVICLMVIFLGTLVHKSSSQGQDRHMIRMR<br>QLIDIVDQLKNYVNDLVPEFLPAPEDVETNCESSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 58 |
| IL-21_ V57P | MRSSPGNMERIVICLMVIFLGTLVHKSSSQGQDRHMIRMR<br>QLIDIVDQLKNYVNDLPPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 59 |
| IL-21_ M39R | MRSSPGNMERIVICLMVIFLGTLVHKSSSQGQDRHMIRRR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 60 |
| IL-21_ Y52K | MRSSPGNMERIVICLMVIFLGTLVHKSSSQGQDRHMIRMR<br>QLIDIVDQLKNKVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 61 |
| IL-21_ F76T | MRSSPGNMERIVICLMVIFLGTLVHKSSSQGQDRHMIRMR<br>QLIDIVDQLKNYVNDLVPEFLPAPEDVETNCEWSATSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 62 |
| IL-21_ F79Y | MRSSPGNMERIVICLMVIFLGTLVHKSSSQGQDRHMIRMR<br>QLIDIVDQLKNYVNDLVPEFLPAPEDVETNCEWSAFSCYQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 63 |
| IL-21_ M39E | MRSSPGNMERIVICLMVIFLGTLVHKSSSQGQDRHMIRER<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 64 |
| IL-21_ 145G | MRSSPGNMERIVICLMVIFLGTLVHKSSSQGQDRHMIRMR<br>QLIDGVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 65 |
| IL-21_ D47S | MRSSPGNMERIVICLMVIFLGTLVHKSSSQGQDRHMIRMR<br>QLIDIVSQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 66 |

TABLE 2-continued

Polypeptide Sequences of Human IL-21 Variants Comprising Single Amino Acid Substitutions

| Variant | Amino Acid Sequence | SEQ ID NO |
|---|---|---|
| IL-21_<br>F79K | MRSSPGNMERIVICLMVIFLGTLVHKSSSQGQDRHMIRMR<br>QLIDIVDQLKNYVNDLVPEFLPAPEDVETNCEWSAFSCKQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 67 |
| IL-21_<br>L49K | MRSSPGNMERIVICLMVIFLGTLVHKSSSQGQDRHMIRMR<br>QLIDIVDQKKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 68 |
| IL-21_<br>L42Q | MRSSPGNMERIVICLMVIFLGTLVHKSSSQGQDRHMIRMR<br>QQIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 69 |
| IL-21_<br>145H | MRSSPGNMERIVICLMVIFLGTLVHKSSSQGQDRHMIRMR<br>QLIDHVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 70 |
| IL-21_<br>L49N | MRSSPGNMERIVICLMVIFLGTLVHKSSSQGQDRHMIRMR<br>QLIDIVDQNKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 71 |
| IL-21_<br>145R | MRSSPGNMERIVICLMVIFLGTLVHKSSSQGQDRHMIRMR<br>QLIDRVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 72 |
| IL-21_<br>137R | MRSSPGNMERIVICLMVIFLGTLVHKSSSQGQDRHMRRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 73 |
| IL-21_<br>L42N | MRSSPGNMERIVICLMVIFLGTLVHKSSSQGQDRHMIRMR<br>QNIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 74 |
| IL-21_<br>R105S | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIINVSIKKLKSKPPSTNAGRRQKHRL<br>TCPSCDSYEKKPPKEFLERFKSLLQKMIHQHLSSRTHGSE<br>DS | 75 |
| IL-21_<br>143S | MRSSPGNMERIVICLMVIFLGTLVHKSSSQGQDRHMIRMR<br>QLSDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 76 |
| IL-21_<br>L49P | MRSSPGNMERIVICLMVIFLGTLVHKSSSQGQDRHMIRMR<br>QLIDIVDQPKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 77 |
| IL-21_<br>195P | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERPINVSIKKLKRKPPSTNAGRRQKHRL<br>TCPSCDSYEKKPPKEFLERFKSLLQKMIHQHLSSRTHGSE<br>DS | 78 |

TABLE 2-continued

Polypeptide Sequences of Human IL-21 Variants Comprising Single Amino Acid Substitutions

| Variant | Amino Acid Sequence | SEQ ID NO |
|---|---|---|
| IL-21_ R38A | MRSSPGNMERIVICLMVIFLGTLVHKSSSQGQDRHMIAMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 79 |
| IL-21_ 145S | MRSSPGNMERIVICLMVIFLGTLVHKSSSQGQDRHMIRMR<br>QLIDSVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 80 |
| IL-21_ R105W | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIINVSIKKLKWKPPSTNAGRRQKHRL<br>TCPSCDSYEKKPPKEFLERFKSLLQKMIHQHLSSRTHGSE<br>DS | 81 |
| IL-21_ V46P | MRSSPGNMERIVICLMVIFLGTLVHKSSSQGQDRHMIRMR<br>QLIDIPDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 82 |
| IL-21_ 145Y | MRSSPGNMERIVICLMVIFLGTLVHKSSSQGQDRHMIRMR<br>QLIDYVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 83 |
| IL-21_ R38Q | MRSSPGNMERIVICLMVIFLGTLVHKSSSQGQDRHMIQMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 84 |
| IL-21_ 196P | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIPNVSIKKLKRKPPSTNAGRRQKHRL<br>TCPSCDSYEKKPPKEFLERFKSLLQKMIHQHLSSRTHGSE<br>DS | 85 |
| IL-21_ F76E | MRSSPGNMERIVICLMVIFLGTLVHKSSSQGQDRHMIRMR<br>QLIDIVDQLKNYVNDLVPEFLPAPEDVETNCEWSAESCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 86 |
| IL-21_ R105A | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIINVSIKKLKAKPPSTNAGRRQKHRL<br>TCPSCDSYEKKPPKEFLERFKSLLQKMIHQHLSSRTHGSE<br>DS | 87 |
| IL-21_ V46D | MRSSPGNMERIVICLMVIFLGTLVHKSSSQGQDRHMIRMR<br>QLIDIDDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 88 |
| IL-21_ V53P | MRSSPGNMERIVICLMVIFLGTLVHKSSSQGQDRHMIRMR<br>QLIDIVDQLKNYPNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 89 |
| IL-21_ M39P | MRSSPGNMERIVICLMVIFLGTLVHKSSSQGQDRHMIRPR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 90 |

TABLE 2-continued

Polypeptide Sequences of Human IL-21 Variants Comprising Single Amino Acid Substitutions

| Variant | Amino Acid Sequence | SEQ ID NO |
|---|---|---|
| IL-21_ 195K | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERKINVSIKKLKRKPPSTNAGRRQKHRL<br>TCPSCDSYEKKPPKEFLERFKSLLQKMIHQHLSSRTHGSE<br>DS | 91 |
| IL-21_ L42K | MRSSPGNMERIVICLMVIFLGTLVHKSSSQGQDRHMIRMR<br>QKIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 92 |
| IL-21_ R105K | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIINVSIKKLKKKPPSTNAGRRQKHRL<br>TCPSCDSYEKKPPKEFLERFKSLLQKMIHQHLSSRTHGSE<br>DS | 93 |
| IL-21_ R38K | MRSSPGNMERIVICLMVIFLGTLVHKSSSQGQDRHMIKMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 94 |
| IL-21_ M39G | MRSSPGNMERIVICLMVIFLGTLVHKSSSQGQDRHMIRGR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 95 |
| IL-21_ L56F | MRSSPGNMERIVICLMVIFLGTLVHKSSSQGQDRHMIRMR<br>QLIDIVDQLKNYVNDFVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 96 |
| IL-21_ 137S | MRSSPGNMERIVICLMVIFLGTLVHKSSSQGQDRHMSRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 97 |
| IL-21_ D44A | MRSSPGNMERIVICLMVIFLGTLVHKSSSQGQDRHMIRMR<br>QLIAIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 98 |
| IL-21_ 137N | MRSSPGNMERIVICLMVIFLGTLVHKSSSQGQDRHMNRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 99 |
| IL-21_ 196T | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERITNVSIKKLKRKPPSTNAGRRQKHRL<br>TCPSCDSYEKKPPKEFLERFKSLLQKMIHQHLSSRTHGSE<br>DS | 100 |
| IL-21_ L56N | MRSSPGNMERIVICLMVIFLGTLVHKSSSQGQDRHMIRMR<br>QLIDIVDQLKNYVNDNVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 101 |
| IL-21_ 145P | MRSSPGNMERIVICLMVIFLGTLVHKSSSQGQDRHMIRMR<br>QLIDPVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 102 |

TABLE 2-continued

Polypeptide Sequences of Human IL-21 Variants Comprising Single Amino Acid Substitutions

| Variant | Amino Acid Sequence | SEQ ID NO |
|---|---|---|
| IL-21_ 196G | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIGNVSIKKLKRKPPSTNAGRRQKHRL TCPSCDSYEKKPPKEFLERFKSLLQKMIHQHLSSRTHGSE DS | 103 |
| IL-21_ E59R | MRSSPGNMERIVICLMVIFLGTLVHKSSSQGQDRHMIRMR QLIDIVDQLKNYVNDLVPRFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 104 |
| IL-21_ Q41P | MRSSPGNMERIVICLMVIFLGTLVHKSSSQGQDRHMIRMR PLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 105 |
| IL-21_ 145D | MRSSPGNMERIVICLMVIFLGTLVHKSSSQGQDRHMIRMR QLIDDVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 106 |
| IL-21_ P108Q | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPQSTNAGRRQKHRL TCPSCDSYEKKPPKEFLERFKSLLQKMIHQHLSSRTHGSE DS | 107 |
| IL-21_ L49S | MRSSPGNMERIVICLMVIFLGTLVHKSSSQGQDRHMIRMR QLIDIVDQSKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 108 |
| IL-21_ L42D | MRSSPGNMERIVICLMVIFLGTLVHKSSSQGQDRHMIRMR QDIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 109 |
| IL-21_ L42S | MRSSPGNMERIVICLMVIFLGTLVHKSSSQGQDRHMIRMR QSIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 110 |
| IL-21_ Q48K | MRSSPGNMERIVICLMVIFLGTLVHKSSSQGQDRHMIRMR QLIDIVDKLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 111 |
| IL-21_ F79T | MRSSPGNMERIVICLMVIFLGTLVHKSSSQGQDRHMIRMR QLIDIVDQLKNYVNDLVPEFLPAPEDVETNCEWSAFSCTQ KAQLKSANTGNNERIINVSIKKLKRKPPSTNAGRRQKHRL TCPSCDSYEKKPPKEFLERFKSLLQKMIHQHLSSRTHGSE DS | 112 |
| IL-21_ 145N | MRSSPGNMERIVICLMVIFLGTLVHKSSSQGQDRHMIRMR QLIDNVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 113 |
| IL-21_ W73P | MRSSPGNMERIVICLMVIFLGTLVHKSSSQGQDRHMIRMR QLIDIVDQLKNYVNDLVPEFLPAPEDVETNCEPSAFSCFQ KAQLKSANTGNNERIINVSIKKLKRKPPSTNAGRRQKHRL TCPSCDSYEKKPPKEFLERFKSLLQKMIHQHLSSRTHGSE DS | 114 |

TABLE 2-continued

Polypeptide Sequences of Human IL-21 Variants Comprising Single Amino Acid Substitutions

| Variant | Amino Acid Sequence | SEQ ID NO |
|---|---|---|
| IL-21_ D44G | MRSSPGNMERIVICLMVIFLGTLVHKSSSQGQDRHMIRMRQLIGIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 115 |
| IL-21_ L120V | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRVTCPSCDSYEKKPPKEFLERFKSLLQKMIHQHLSSRTHGSEDS | 116 |
| IL-21_ 1148S | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMSHQHLSSRTHGSEDS | 117 |
| IL-21_ F79D | MRSSPGNMERIVICLMVIFLGTLVHKSSSQGQDRHMIRMRQLIDIVDQLKNYVNDLVPEFLPAPEDVETNCEWSAFSCDQKAQLKSANTGNNERIINVSIKKLKRKPPSTNAGRRQKHRLTCPSCDSYEKKPPKEFLERFKSLLQKMIHQHLSSRTHGSEDS | 118 |
| IL-21_ 137G | MRSSPGNMERIVICLMVIFLGTLVHKSSSQGQDRHMGRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 119 |
| IL-21_ L49R | MRSSPGNMERIVICLMVIFLGTLVHKSSSQGQDRHMIRMRQLIDIVDQRKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 120 |
| IL-21_ 196A | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIANVSIKKLKRKPPSTNAGRRQKHRLTCPSCDSYEKKPPKEFLERFKSLLQKMIHQHLSSRTHGSEDS | 121 |
| IL-21_ 195H | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERHINVSIKKLKRKPPSTNAGRRQKHRLTCPSCDSYEKKPPKEFLERFKSLLQKMIHQHLSSRTHGSEDS | 122 |
| IL-21_ W73G | MRSSPGNMERIVICLMVIFLGTLVHKSSSQGQDRHMIRMRQLIDIVDQLKNYVNDLVPEFLPAPEDVETNCEGSAFSCFQKAQLKSANTGNNERIINVSIKKLKRKPPSTNAGRRQKHRLTCPSCDSYEKKPPKEFLERFKSLLQKMIHQHLSSRTHGSEDS | 123 |
| IL-21_ V98K | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINKSIKKLKRKPPSTNAGRRQKHRLTCPSCDSYEKKPPKEFLERFKSLLQKMIHQHLSSRTHGSEDS | 124 |
| IL-21_ V53Q | MRSSPGNMERIVICLMVIFLGTLVHKSSSQGQDRHMIRMRQLIDIVDQLKNYQNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 125 |
| IL-21_ P108G | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPGSTNAGRRQKHRLTCPSCDSYEKKPPKEFLERFKSLLQKMIHQHLSSRTHGSEDS | 126 |

TABLE 2-continued

Polypeptide Sequences of Human IL-21 Variants Comprising Single Amino Acid Substitutions

| Variant | Amino Acid Sequence | SEQ ID NO |
|---|---|---|
| IL-21_ D33P | MRSSPGNMERIVICLMVIFLGTLVHKSSSQGQPRHMIRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 127 |
| IL-21_ F79R | MRSSPGNMERIVICLMVIFLGTLVHKSSSQGQDRHMIRMR<br>QLIDIVDQLKNYVNDLVPEFLPAPEDVETNCEWSAFSCRQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 128 |
| IL-21_ W73N | MRSSPGNMERIVICLMVIFLGTLVHKSSSQGQDRHMIRMR<br>QLIDIVDQLKNYVNDLVPEFLPAPEDVETNCENSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 129 |
| IL-21_ 196S | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERISNVSIKKLKRKPPSTNAGRRQKHRL<br>TCPSCDSYEKKPPKEFLERFKSLLQKMIHQHLSSRTHGSE<br>DS | 130 |
| IL-21_ R38M | MRSSPGNMERIVICLMVIFLGTLVHKSSSQGQDRHMIMMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 131 |
| IL-21_ V98R | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIINRSIKKLKRKPPSTNAGRRQKHRL<br>TCPSCDSYEKKPPKEFLERFKSLLQKMIHQHLSSRTHGSE<br>DS | 132 |
| IL-21_ P132A | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKAPKEFLERFKSLLQKMIHQHLSSRTHGSE<br>DS | 133 |
| IL-21_ L42R | MRSSPGNMERIVICLMVIFLGTLVHKSSSQGQDRHMIRMR<br>QRIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 134 |
| IL-21_ D33R | MRSSPGNMERIVICLMVIFLGTLVHKSSSQGQRRHMIRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 135 |
| IL-21_ Y52N | MRSSPGNMERIVICLMVIFLGTLVHKSSSQGQDRHMIRMR<br>QLIDIVDQLKNNVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 136 |
| IL-21_ L56E | MRSSPGNMERIVICLMVIFLGTLVHKSSSQGQDRHMIRMR<br>QLIDIVDQLKNYVNDEVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 137 |
| IL-21_ 137E | MRSSPGNMERIVICLMVIFLGTLVHKSSSQGQDRHMERMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 138 |

TABLE 2-continued

| Polypeptide Sequences of Human IL-21 Variants Comprising Single Amino Acid Substitutions | | |
|---|---|---|
| Variant | Amino Acid Sequence | SEQ ID NO |
| IL-21_ R38E | MRSSPGNMERIVICLMVIFLGTLVHKSSSQGQDRHMIEMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 139 |
| IL-21_ F79E | MRSSPGNMERIVICLMVIFLGTLVHKSSSQGQDRHMIRMR QLIDIVDQLKNYVNDLVPEFLPAPEDVETNCEWSAFSCEQ KAQLKSANTGNNERIINVSIKKLKRKPPSTNAGRRQKHRL TCPSCDSYEKKPPKEFLERFKSLLQKMIHQHLSSRTHGSE DS | 140 |
| IL-21_ P62V | MRSSPGNMERIVICLMVIFLGTLVHKSSSQGQDRHMIRMR QLIDIVDQLKNYVNDLVPEFLVAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 141 |
| IL-21_ L56T | MRSSPGNMERIVICLMVIFLGTLVHKSSSQGQDRHMIRMR QLIDIVDQLKNYVNDTVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 142 |
| IL-21_ 137K | MRSSPGNMERIVICLMVIFLGTLVHKSSSQGQDRHMKRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 143 |
| IL-21_ S74H | MRSSPGNMERIVICLMVIFLGTLVHKSSSQGQDRHMIRMR QLIDIVDQLKNYVNDLVPEFLPAPEDVETNCEWHAFSCFQ KAQLKSANTGNNERIINVSIKKLKRKPPSTNAGRRQKHRL TCPSCDSYEKKPPKEFLERFKSLLQKMIHQHLSSRTHGSE DS | 144 |
| IL-21_ Y52H | MRSSPGNMERIVICLMVIFLGTLVHKSSSQGQDRHMIRMR QLIDIVDQLKNHVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 145 |
| IL-21_ D44T | MRSSPGNMERIVICLMVIFLGTLVHKSSSQGQDRHMIRMR QLITIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 146 |
| IL-21_ Y52Q | MRSSPGNMERIVICLMVIFLGTLVHKSSSQGQDRHMIRMR QLIDIVDQLKNQVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 147 |
| IL-21_ D44N | MRSSPGNMERIVICLMVIFLGTLVHKSSSQGQDRHMIRMR QLINIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 148 |
| IL-21_ S99H | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVHIKKLKRKPPSTNAGRRQKHRL TCPSCDSYEKKPPKEFLERFKSLLQKMIHQHLSSRTHGSE DS | 149 |
| IL-21_ V53H | MRSSPGNMERIVICLMVIFLGTLVHKSSSQGQDRHMIRMR QLIDIVDQLKNYHNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 150 |

TABLE 2-continued

Polypeptide Sequences of Human IL-21 Variants Comprising Single Amino Acid Substitutions

| Variant | Amino Acid Sequence | SEQ ID NO |
|---|---|---|
| IL-21_ S77R | MRSSPGNMERIVICLMVIFLGTLVHKSSSQGQDRHMIRMR QLIDIVDQLKNYVNDLVPEFLPAPEDVETNCEWSAFRCFQ KAQLKSANTGNNERIINVSIKKLKRKPPSTNAGRRQKHRL TCPSCDSYEKKPPKEFLERFKSLLQKMIHQHLSSRTHGSE DS | 151 |
| IL-21_ S109K | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPKTNAGRRQKHRL TCPSCDSYEKKPPKEFLERFKSLLQKMIHQHLSSRTHGSE DS | 152 |
| IL-21_ I95T | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERTINVSIKKLKRKPPSTNAGRRQKHRL TCPSCDSYEKKPPKEFLERFKSLLQKMIHQHLSSRTHGSE DS | 153 |
| IL-21_ W73L | MRSSPGNMERIVICLMVIFLGTLVHKSSSQGQDRHMIRMR QLIDIVDQLKNYVNDLVPEFLPAPEDVETNCELSAFSCFQ KAQLKSANTGNNERIINVSIKKLKRKPPSTNAGRRQKHRL TCPSCDSYEKKPPKEFLERFKSLLQKMIHQHLSSRTHGSE DS | 154 |
| IL-21_ S74N | MRSSPGNMERIVICLMVIFLGTLVHKSSSQGQDRHMIRMR QLIDIVDQLKNYVNDLVPEFLPAPEDVETNCEWNAFSCFQ KAQLKSANTGNNERIINVSIKKLKRKPPSTNAGRRQKHRL TCPSCDSYEKKPPKEFLERFKSLLQKMIHQHLSSRTHGSE DS | 155 |
| IL-21_ Q145H | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLHKMIHQHLSSRTHGSE DS | 156 |
| IL-21_ V53E | MRSSPGNMERIVICLMVIFLGTLVHKSSSQGQDRHMIRMR QLIDIVDQLKNYENDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 157 |
| IL-21_ V53T | MRSSPGNMERIVICLMVIFLGTLVHKSSSQGQDRHMIRMR QLIDIVDQLKNYTNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 158 |
| IL-21_ K131M | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKMPPKEFLERFKSLLQKMIHQHLSSRTHGSE DS | 159 |
| IL-21_ W73A | MRSSPGNMERIVICLMVIFLGTLVHKSSSQGQDRHMIRMR QLIDIVDQLKNYVNDLVPEFLPAPEDVETNCEASAFSCFQ KAQLKSANTGNNERIINVSIKKLKRKPPSTNAGRRQKHRL TCPSCDSYEKKPPKEFLERFKSLLQKMIHQHLSSRTHGSE DS | 160 |
| IL-21_ R34S | MRSSPGNMERIVICLMVIFLGTLVHKSSSQGQDSHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 161 |
| IL-21_ L120H | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPSTNAGRRQKHRH TCPSCDSYEKKPPKEFLERFKSLLQKMIHQHLSSRTHGSE DS | 162 |

TABLE 2-continued

Polypeptide Sequences of Human IL-21 Variants Comprising Single Amino Acid Substitutions

| Variant | Amino Acid Sequence | SEQ ID NO |
|---|---|---|
| IL-21_ N88K | MRSSPGNMERIVICLMVIFLGTLVHKSSSQGQDRHMIRMR QLIDIVDQLKNYVNDLVPEFLPAPEDVETNCEWSAFSCFQ KAQLKSAKTGNNERIINVSIKKLKRKPPSTNAGRRQKHRL TCPSCDSYEKKPPKEFLERFKSLLQKMIHQHLSSRTHGSE DS | 163 |
| IL-21_ R34W | MRSSPGNMERIVICLMVIFLGTLVHKSSSQGQDWHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 164 |
| IL-21_ D33A | MRSSPGNMERIVICLMVIFLGTLVHKSSSQGQARHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 165 |
| IL-21_ L61I | MRSSPGNMERIVICLMVIFLGTLVHKSSSQGQDRHMIRMR QLIDIVDQLKNYVNDLVPEFIPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 166 |
| IL-21_ I37Q | MRSSPGNMERIVICLMVIFLGTLVHKSSSQGQDRHMQRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 167 |
| IL-21_ R34D | MRSSPGNMERIVICLMVIFLGTLVHKSSSQGQDDHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 168 |
| IL-21_ T89L | MRSSPGNMERIVICLMVIFLGTLVHKSSSQGQDRHMIRMR QLIDIVDQLKNYVNDLVPEFLPAPEDVETNCEWSAFSCFQ KAQLKSANLGNNERIINVSIKKLKRKPPSTNAGRRQKHRL TCPSCDSYEKKPPKEFLERFKSLLQKMIHQHLSSRTHGSE DS | 169 |
| IL-21_ D33T | MRSSPGNMERIVICLMVIFLGTLVHKSSSQGQTRHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 170 |
| IL-21_ W73Q | MRSSPGNMERIVICLMVIFLGTLVHKSSSQGQDRHMIRMR QLIDIVDQLKNYVNDLVPEFLPAPEDVETNCEQSAFSCFQ KAQLKSANTGNNERIINVSIKKLKRKPPSTNAGRRQKHRL TCPSCDSYEKKPPKEFLERFKSLLQKMIHQHLSSRTHGSE DS | 171 |
| IL-21_ S77K | MRSSPGNMERIVICLMVIFLGTLVHKSSSQGQDRHMIRMR QLIDIVDQLKNYVNDLVPEFLPAPEDVETNCEWSAFKCFQ KAQLKSANTGNNERIINVSIKKLKRKPPSTNAGRRQKHRL TCPSCDSYEKKPPKEFLERFKSLLQKMIHQHLSSRTHGSE DS | 172 |
| IL-21_ R34K | MRSSPGNMERIVICLMVIFLGTLVHKSSSQGQDKHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 173 |
| IL-21_ D33N | MRSSPGNMERIVICLMVIFLGTLVHKSSSQGQNRHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 174 |

TABLE 2-continued

Polypeptide Sequences of Human IL-21 Variants Comprising Single Amino Acid Substitutions

| Variant | Amino Acid Sequence | SEQ ID NO |
|---|---|---|
| IL-21_ V57R | MRSSPGNMERIVICLMVIFLGTLVHKSSSQGQDRHMIRMR QLIDIVDQLKNYVNDLRPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 175 |
| IL-21_ Q150R | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHRHLSSRTHGSE DS | 176 |
| IL-21_ D33S | MRSSPGNMERIVICLMVIFLGTLVHKSSSQGQSRHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 177 |
| IL-21_ E72S | MRSSPGNMERIVICLMVIFLGTLVHKSSSQGQDRHMIRMR QLIDIVDQLKNYVNDLVPEFLPAPEDVETNCSWSAFSCFQ KAQLKSANTGNNERIINVSIKKLKRKPPSTNAGRRQKHRL TCPSCDSYEKKPPKEFLERFKSLLQKMIHQHLSSRTHGSE DS | 178 |
| IL-21_ H118R | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPSTNAGRRQKRRL TCPSCDSYEKKPPKEFLERFKSLLQKMIHQHLSSRTHGSE DS | 179 |
| IL-21_ S142H | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKHLLQKMIHQHLSSRTHGSE DS | 180 |
| IL-21_ R34H | MRSSPGNMERIVICLMVIFLGTLVHKSSSQGQDHHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 181 |
| IL-21_ R34G | MRSSPGNMERIVICLMVIFLGTLVHKSSSQGQDGHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 182 |
| IL-21_ V98H | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINHSIKKLKRKPPSTNAGRRQKHRL TCPSCDSYEKKPPKEFLERFKSLLQKMIHQHLSSRTHGSE DS | 183 |
| IL-21_ L120K | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPSTNAGRRQKHRK TCPSCDSYEKKPPKEFLERFKSLLQKMIHQHLSSRTHGSE DS | 184 |
| IL-21_ N51P | MRSSPGNMERIVICLMVIFLGTLVHKSSSQGQDRHMIRMR QLIDIVDQLKPYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 185 |
| IL-21_ 145A | MRSSPGNMERIVICLMVIFLGTLVHKSSSQGQDRHMIRMR QLIDAVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 186 |

TABLE 2-continued

Polypeptide Sequences of Human IL-21 Variants Comprising Single Amino Acid Substitutions

| Variant | Amino Acid Sequence | SEQ ID NO |
|---|---|---|
| IL-21_ P108L | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPLSTNAGRRQKHRL TCPSCDSYEKKPPKEFLERFKSLLQKMIHQHLSSRTHGSE DS | 187 |
| IL-21_ N54K | MRSSPGNMERIVICLMVIFLGTLVHKSSSQGQDRHMIRMR QLIDIVDQLKNYVKDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 188 |
| IL-21_ A112R | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPSTNRGRRQKHRL TCPSCDSYEKKPPKEFLERFKSLLQKMIHQHLSSRTHGSE DS | 189 |
| IL-21_ F60I | MRSSPGNMERIVICLMVIFLGTLVHKSSSQGQDRHMIRMR QLIDIVDQLKNYVNDLVPEILPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 190 |
| IL-21_ N97G | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIIGVSIKKLKRKPPSTNAGRRQKHRL TCPSCDSYEKKPPKEFLERFKSLLQKMIHQHLSSRTHGSE DS | 191 |
| IL-21_ D33Q | MRSSPGNMERIVICLMVIFLGTLVHKSSSQGQQRHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 192 |
| IL-21_ E93G | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNGRIINVSIKKLKRKPPSTNAGRRQKHRL TCPSCDSYEKKPPKEFLERFKSLLQKMIHQHLSSRTHGSE DS | 193 |
| IL-21_ H118K | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPSTNAGRRQKKRL TCPSCDSYEKKPPKEFLERFKSLLQKMIHQHLSSRTHGSE DS | 194 |
| IL-21_ L56M | MRSSPGNMERIVICLMVIFLGTLVHKSSSQGQDRHMIRMR QLIDIVDQLKNYVNDMVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 195 |
| IL-21_ P107Y | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKYPSTNAGRRQKHRL TCPSCDSYEKKPPKEFLERFKSLLQKMIHQHLSSRTHGSE DS | 196 |
| IL-21_ E68R | MRSSPGNMERIVICLMVIFLGTLVHKSSSQGQDRHMIRMR QLIDIVDQLKNYVNDLVPEFLPAPEDVRTNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 197 |
| IL-21_ S109R | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPRTNAGRRQKHRL TCPSCDSYEKKPPKEFLERFKSLLQKMIHQHLSSRTHGSE DS | 198 |

TABLE 2-continued

Polypeptide Sequences of Human IL-21 Variants Comprising Single Amino Acid Substitutions

| Variant | Amino Acid Sequence | SEQ ID NO |
|---|---|---|
| IL-21_ N54P | MRSSPGNMERIVICLMVIFLGTLVHKSSSQGQDRHMIRMR QLIDIVDQLKNYVPDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 199 |
| IL-21_ P62H | MRSSPGNMERIVICLMVIFLGTLVHKSSSQGQDRHMIRMR QLIDIVDQLKNYVNDLVPEFLHAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 200 |
| IL-21_ E59S | MRSSPGNMERIVICLMVIFLGTLVHKSSSQGQDRHMIRMR QLIDIVDQLKNYVNDLVPSFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 201 |
| IL-21_ E721 | MRSSPGNMERIVICLMVIFLGTLVHKSSSQGQDRHMIRMR QLIDIVDQLKNYVNDLVPEFLPAPEDVETNCIWSAFSCFQ KAQLKSANTGNNERIINVSIKKLKRKPPSTNAGRRQKHRL TCPSCDSYEKKPPKEFLERFKSLLQKMIHQHLSSRTHGSE DS | 202 |
| IL-21_ P62T | MRSSPGNMERIVICLMVIFLGTLVHKSSSQGQDRHMIRMR QLIDIVDQLKNYVNDLVPEFLTAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 203 |
| IL-21_ L152H | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHHSSRTHGSE DS | 204 |
| IL-21_ S74A | MRSSPGNMERIVICLMVIFLGTLVHKSSSQGQDRHMIRMR QLIDIVDQLKNYVNDLVPEFLPAPEDVETNCEWAAFSCFQ KAQLKSANTGNNERIINVSIKKLKRKPPSTNAGRRQKHRL TCPSCDSYEKKPPKEFLERFKSLLQKMIHQHLSSRTHGSE DS | 205 |
| IL-21_ N70H | MRSSPGNMERIVICLMVIFLGTLVHKSSSQGQDRHMIRMR QLIDIVDQLKNYVNDLVPEFLPAPEDVETHCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 206 |
| IL-21_ F76M | MRSSPGNMERIVICLMVIFLGTLVHKSSSQGQDRHMIRMR QLIDIVDQLKNYVNDLVPEFLPAPEDVETNCEWSAMSCFQ KAQLKSANTGNNERIINVSIKKLKRKPPSTNAGRRQKHRL TCPSCDSYEKKPPKEFLERFKSLLQKMIHQHLSSRTHGSE DS | 207 |
| IL-21_ S861 | MRSSPGNMERIVICLMVIFLGTLVHKSSSQGQDRHMIRMR QLIDIVDQLKNYVNDLVPEFLPAPEDVETNCEWSAFSCFQ KAQLKIANTGNNERIINVSIKKLKRKPPSTNAGRRQKHRL TCPSCDSYEKKPPKEFLERFKSLLQKMIHQHLSSRTHGSE DS | 208 |
| IL-21_ F60R | MRSSPGNMERIVICLMVIFLGTLVHKSSSQGQDRHMIRMR QLIDIVDQLKNYVNDLVPERLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 209 |
| IL-21_ P1081 | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPISTNAGRRQKHRL TCPSCDSYEKKPPKEFLERFKSLLQKMIHQHLSSRTHGSE DS | 210 |

TABLE 2-continued

Polypeptide Sequences of Human IL-21 Variants Comprising Single Amino Acid Substitutions

| Variant | Amino Acid Sequence | SEQ ID NO |
|---|---|---|
| IL-21_<br>N54H | MRSSPGNMERIVICLMVIFLGTLVHKSSSQGQDRHMIRMR<br>QLIDIVDQLKNYVHDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 211 |
| IL-21_<br>R34E | MRSSPGNMERIVICLMVIFLGTLVHKSSSQGQDEHMIRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 212 |
| IL-21_<br>A87N | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSNNTGNNERIINVSIKKLKRKPPSTNAGRRQKHRL<br>TCPSCDSYEKKPPKEFLERFKSLLQKMIHQHLSSRTHGSE<br>DS | 213 |
| IL-21_<br>W73Y | MRSSPGNMERIVICLMVIFLGTLVHKSSSQGQDRHMIRMR<br>QLIDIVDQLKNYVNDLVPEFLPAPEDVETNCEYSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 214 |
| IL-21_<br>143M | MRSSPGNMERIVICLMVIFLGTLVHKSSSQGQDRHMIRMR<br>QLMDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 215 |
| IL-21_<br>E72H | MRSSPGNMERIVICLMVIFLGTLVHKSSSQGQDRHMIRMR<br>QLIDIVDQLKNYVNDLVPEFLPAPEDVETNCHWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 216 |
| IL-21_<br>R34Y | MRSSPGNMERIVICLMVIFLGTLVHKSSSQGQDYHMIRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 217 |
| IL-21_<br>A63T | MRSSPGNMERIVICLMVIFLGTLVHKSSSQGQDRHMIRMR<br>QLIDIVDQLKNYVNDLVPEFLPTPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 218 |
| IL-21_<br>E68K | MRSSPGNMERIVICLMVIFLGTLVHKSSSQGQDRHMIRMR<br>QLIDIVDQLKNYVNDLVPEFLPAPEDVKTNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 219 |
| IL-21_<br>Q48G | MRSSPGNMERIVICLMVIFLGTLVHKSSSQGQDRHMIRMR<br>QLIDIVDGLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 220 |
| IL-21_<br>137V | MRSSPGNMERIVICLMVIFLGTLVHKSSSQGQDRHMVRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 221 |
| IL-21_<br>M36T | MRSSPGNMERIVICLMVIFLGTLVHKSSSQGQDRHTIRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 222 |

TABLE 2-continued

| Polypeptide Sequences of Human IL-21 Variants Comprising Single Amino Acid Substitutions | | |
|---|---|---|
| Variant | Amino Acid Sequence | SEQ ID NO |
| IL-21_ Q41S | MRSSPGNMERIVICLMVIFLGTLVHKSSSQGQDRHMIRMR SLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 223 |
| IL-21_ R139S | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLESFKSLLQKMIHQHLSSRTHGSE DS | 224 |
| IL-21_ 196V | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIVNVSIKKLKRKPPSTNAGRRQKHRL TCPSCDSYEKKPPKEFLERFKSLLQKMIHQHLSSRTHGSE DS | 225 |
| IL-21_ P1331 | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPIKEFLERFKSLLQKMIHQHLSSRTHGSE DS | 226 |
| IL-21_ E72T | MRSSPGNMERIVICLMVIFLGTLVHKSSSQGQDRHMIRMR QLIDIVDQLKNYVNDLVPEFLPAPEDVETNCTWSAFSCFQ KAQLKSANTGNNERIINVSIKKLKRKPPSTNAGRRQKHRL TCPSCDSYEKKPPKEFLERFKSLLQKMIHQHLSSRTHGSE DS | 227 |
| IL-21_ P108E | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPESTNAGRRQKHRL TCPSCDSYEKKPPKEFLERFKSLLQKMIHQHLSSRTHGSE DS | 228 |
| IL-21_ P62S | MRSSPGNMERIVICLMVIFLGTLVHKSSSQGQDRHMIRMR QLIDIVDQLKNYVNDLVPEFLSAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 229 |
| IL-21_ Q32K | MRSSPGNMERIVICLMVIFLGTLVHKSSSQGKDRHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 230 |
| IL-21_ D66R | MRSSPGNMERIVICLMVIFLGTLVHKSSSQGQDRHMIRMR QLIDIVDQLKNYVNDLVPEFLPAPERVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 231 |
| IL-21_ V57L | MRSSPGNMERIVICLMVIFLGTLVHKSSSQGQDRHMIRMR QLIDIVDQLKNYVNDLLPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 232 |
| IL-21_ R34P | MRSSPGNMERIVICLMVIFLGTLVHKSSSQGQDPHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 233 |
| IL-21_ S1421 | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKILLQKMIHQHLSSRTHGSE DS | 234 |

TABLE 2-continued

Polypeptide Sequences of Human IL-21 Variants Comprising Single Amino Acid Substitutions

| Variant | Amino Acid Sequence | SEQ ID NO |
|---|---|---|
| IL-21_S109M | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPMTNAGRRQKHRLTCPSCDSYEKKPPKEFLERFKSLLQKMIHQHLSSRTHGSEDS | 235 |
| IL-21_M391 | MRSSPGNMERIVICLMVIFLGTLVHKSSSQGQDRHMIRIRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 236 |
| IL-21_N51V | MRSSPGNMERIVICLMVIFLGTLVHKSSSQGQDRHMIRMRQLIDIVDQLKVYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 237 |
| IL-21_E93T | MRSSPGNMERIVICLMVIFLGTLVHKSSSQGQDRHMIRMRQLIDIVDQLKNYVNDLVPEFLPAPEDVETNCEWSAFSCFQKAQLKSANTGNNTRIINVSIKKLKRKPPSTNAGRRQKHRLTCPSCDSYEKKPPKEFLERFKSLLQKMIHQHLSSRTHGSEDS | 238 |
| IL-21_F60H | MRSSPGNMERIVICLMVIFLGTLVHKSSSQGQDRHMIRMRQLIDIVDQLKNYVNDLVPEHLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 239 |
| IL-21_N51G | MRSSPGNMERIVICLMVIFLGTLVHKSSSQGQDRHMIRMRQLIDIVDQLKGYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 240 |
| IL-21_V57T | MRSSPGNMERIVICLMVIFLGTLVHKSSSQGQDRHMIRMRQLIDIVDQLKNYVNDLTPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 241 |
| IL-21_V57M | MRSSPGNMERIVICLMVIFLGTLVHKSSSQGQDRHMIRMRQLIDIVDQLKNYVNDLMPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 242 |
| IL-21_L61H | MRSSPGNMERIVICLMVIFLGTLVHKSSSQGQDRHMIRMRQLIDIVDQLKNYVNDLVPEFHPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 243 |
| IL-21_L42Y | MRSSPGNMERIVICLMVIFLGTLVHKSSSQGQDRHMIRMRQYIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 244 |
| IL-21_D66M | MRSSPGNMERIVICLMVIFLGTLVHKSSSQGQDRHMIRMRQLIDIVDQLKNYVNDLVPEFLPAPEMVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 245 |
| IL-21_R34N | MRSSPGNMERIVICLMVIFLGTLVHKSSSQGQDNHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 246 |

TABLE 2-continued

Polypeptide Sequences of Human IL-21 Variants Comprising Single Amino Acid Substitutions

| Variant | Amino Acid Sequence | SEQ ID NO |
|---|---|---|
| IL-21_ R34F | MRSSPGNMERIVICLMVIFLGTLVHKSSSQGQDFHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 247 |
| IL-21_ V57Y | MRSSPGNMERIVICLMVIFLGTLVHKSSSQGQDRHMIRMR QLIDIVDQLKNYVNDLYPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 248 |
| IL-21_ K104G | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLGRKPPSTNAGRRQKHRL TCPSCDSYEKKPPKEFLERFKSLLQKMIHQHLSSRTHGSE DS | 249 |
| IL-21_ H151E | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQELSSRTHGSE DS | 250 |
| IL-21_ L120M | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPSTNAGRRQKHRM TCPSCDSYEKKPPKEFLERFKSLLQKMIHQHLSSRTHGSE DS | 251 |
| IL-21_ K106S | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRSPPSTNAGRRQKHRL TCPSCDSYEKKPPKEFLERFKSLLQKMIHQHLSSRTHGSE DS | 252 |
| IL-21_ E72L | MRSSPGNMERIVICLMVIFLGTLVHKSSSQGQDRHMIRMR QLIDIVDQLKNYVNDLVPEFLPAPEDVETNCLWSAFSCFQ KAQLKSANTGNNERIINVSIKKLKRKPPSTNAGRRQKHRL TCPSCDSYEKKPPKEFLERFKSLLQKMIHQHLSSRTHGSE DS | 253 |
| IL-21_ 143L | MRSSPGNMERIVICLMVIFLGTLVHKSSSQGQDRHMIRMR QLLDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 254 |
| IL-21_ P108D | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPDSTNAGRRQKHRL TCPSCDSYEKKPPKEFLERFKSLLQKMIHQHLSSRTHGSE DS | 255 |
| IL-21_ V53S | MRSSPGNMERIVICLMVIFLGTLVHKSSSQGQDRHMIRMR QLIDIVDQLKNYSNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 256 |
| IL-21_ R34Q | MRSSPGNMERIVICLMVIFLGTLVHKSSSQGQDQHMIRMR QLIDIVDQLKNYVNDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 257 |
| IL-21_ V53A | MRSSPGNMERIVICLMVIFLGTLVHKSSSQGQDRHMIRMR QLIDIVDQLKNYANDLVPEFLPAPEDVETNCEWSAFSCFQ KAQLKSANTGNNERIINVSIKKLKRKPPSTNAGRRQKHRL TCPSCDSYEKKPPKEFLERFKSLLQKMIHQHLSSRTHGSE DS | 258 |

TABLE 2-continued

Polypeptide Sequences of Human IL-21 Variants Comprising Single Amino Acid Substitutions

| Variant | Amino Acid Sequence | SEQ ID NO |
|---|---|---|
| IL-21_ K106N | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIINVSIKKLKRNPPSTNAGRRQKHRL<br>TCPSCDSYEKKPPKEFLERFKSLLQKMIHQHLSSRTHGSE<br>DS | 259 |
| IL-21_ A112P | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIINVSIKKLKRKPPSTNPGRRQKHRL<br>TCPSCDSYEKKPPKEFLERFKSLLQKMIHQHLSSRTHGSE<br>DS | 260 |
| IL-21_ Q150D | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHDHLSSRTHGSE<br>DS | 261 |
| IL-21_ Q150S | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHSHLSSRTHGSE<br>DS | 262 |
| IL-21_ K106P | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIINVSIKKLKRPPPSTNAGRRQKHRL<br>TCPSCDSYEKKPPKEFLERFKSLLQKMIHQHLSSRTHGSE<br>DS | 263 |
| IL-21_ R34A | MRSSPGNMERIVICLMVIFLGTLVHKSSSQGQDAHMIRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 264 |
| IL-21_ N70A | MRSSPGNMERIVICLMVIFLGTLVHKSSSQGQDRHMIRMR<br>QLIDIVDQLKNYVNDLVPEFLPAPEDVETACEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 265 |
| IL-21_ R34V | MRSSPGNMERIVICLMVIFLGTLVHKSSSQGQDVHMIRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 266 |
| IL-21_ L120Y | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIINVSIKKLKRKPPSTNAGRRQKHRY<br>TCPSCDSYEKKPPKEFLEREKSLLQKMIHQHLSSRTHGSE<br>DS | 267 |
| IL-21_ R38F | MRSSPGNMERIVICLMVIFLGTLVHKSSSQGQDRHMIFMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 268 |
| IL-21_ S77M | MRSSPGNMERIVICLMVIFLGTLVHKSSSQGQDRHMIRMR<br>QLIDIVDQLKNYVNDLVPEFLPAPEDVETNCEWSAFMCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 269 |
| IL-21_ K85S | MRSSPGNMERIVICLMVIFLGTLVHKSSSQGQDRHMIRMR<br>QLIDIVDQLKNYVNDLVPEFLPAPEDVETNCEWSAFSCFQ<br>KAQLSSANTGNNERIINVSIKKLKRKPPSTNAGRRQKHRL<br>TCPSCDSYEKKPPKEFLERFKSLLQKMIHQHLSSRTHGSE<br>DS | 270 |

TABLE 2-continued

| Polypeptide Sequences of Human IL-21 Variants Comprising Single Amino Acid Substitutions | | |
|---|---|---|
| Variant | Amino Acid Sequence | SEQ ID NO |
| IL-21_ R94S | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNESIINVSIKKLKRKPPSTNAGRRQKHRL<br>TCPSCDSYEKKPPKEFLERFKSLLQKMIHQHLSSRTHGSE<br>DS | 271 |
| IL-21_ H35P | MRSSPGNMERIVICLMVIFLGTLVHKSSSQGQDRPMIRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 272 |
| IL-21_ R114F | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIINVSIKKLKRKPPSTNAGERQKHRL<br>TCPSCDSYEKKPPKEFLERFKSLLQKMIHQHLSSRTHGSE<br>DS | 273 |
| IL-21_ S142D | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKDLLQKMIHQHLSSRTHGSE<br>DS | 274 |
| IL-21_ R34M | MRSSPGNMERIVICLMVIFLGTLVHKSSSQGQDMHMIRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 275 |
| IL-21_ R34T | MRSSPGNMERIVICLMVIFLGTLVHKSSSQGQDTHMIRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 276 |
| IL-21_ R34L | MRSSPGNMERIVICLMVIFLGTLVHKSSSQGQDLHMIRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 277 |
| IL-21_ R94T | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNETIINVSIKKLKRKPPSTNAGRRQKHRL<br>TCPSCDSYEKKPPKEFLERFKSLLQKMIHQHLSSRTHGSE<br>DS | 278 |
| IL-21_ R1151 | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIINVSIKKLKRKPPSTNAGRIQKHRL<br>TCPSCDSYEKKPPKEFLERFKSLLQKMIHQHLSSRTHGSE<br>DS | 279 |
| IL-21_ N51E | MRSSPGNMERIVICLMVIFLGTLVHKSSSQGQDRHMIRMR<br>QLIDIVDQLKEYVNDLVPEFLPAPEDVETNCEWSAFSCFQ<br>KAQLKSANTGNNERIINVSIKKLKRKPPSTNAGRRQKHRL<br>TCPSCDSYEKKPPKEFLERFKSLLQKMIHQHLSSRTHGSE<br>DS | 280 |
| IL-21_ K131V | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIINVSIKKLKRKPPSTNAGRRQKHRL<br>TCPSCDSYEKVPPKEFLERFKSLLQKMIHQHLSSRTHGSE<br>DS | 281 |
| IL-21_ K106T | MRSSPGNMERIVICLMVIFLGTLVHKSSSQGQDRHMIRMR<br>QLIDIVDQLKNYVNDLVPEFLPAPEDVETNCEWSAFSCFQ<br>KAQLKSANTGNNERIINVSIKKLKRTPPSTNAGRRQKHRL<br>TCPSCDSYEKKPPKEFLERFKSLLQKMIHQHLSSRTHGSE<br>DS | 282 |

TABLE 2-continued

Polypeptide Sequences of Human IL-21 Variants Comprising Single Amino Acid Substitutions

| Variant | Amino Acid Sequence | SEQ ID NO |
|---|---|---|
| IL-21_ P107D | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKDPSTNAGRRQKHRL TCPSCDSYEKKPPKEFLERFKSLLQKMIHQHLSSRTHGSE DS | 283 |
| IL-21_ H1181 | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPSTNAGRRQKIRL TCPSCDSYEKKPPKEFLERFKSLLQKMIHQHLSSRTHGSE DS | 284 |
| IL-21_ K106E | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKREPPSTNAGRRQKHRL TCPSCDSYEKKPPKEFLERFKSLLQKMIHQHLSSRTHGSE DS | 285 |
| IL-21_ R115Q | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPSTNAGRQQKHRL TCPSCDSYEKKPPKEFLERFKSLLQKMIHQHLSSRTHGSE DS | 286 |
| IL-21_ R115P | MRSSPGNMERIVICLMVIFLGTLVHKSSSQGQDRHMIRMR QLIDIVDQLKNYVNDLVPEFLPAPEDVETNCEWSAFSCFQ KAQLKSANTGNNERIINVSIKKLKRKPPSTNAGRPQKHRL TCPSCDSYEKKPPKEFLERFKSLLQKMIHQHLSSRTHGSE DS | 287 |

Table 3 below discloses 812 mouse IL-21 variants comprising single amino acid substitutions, with single amino acid substitutions throughout the length of the wild-type mouse IL-21 polypeptide (SEQ ID NO: 3) with reduced affinity for mouse IL-21R (SEQ ID NO: 4). Any variant found to bind mouse IL-21R with a half-log affinity weaker than wild-type mouse IL-21 as measured by AlphaSeq™ (cutoff=2.5 M in unbuffered media, 10 nM in pH 7 media, 23 nM in pH 6 media, and 101 nM in pH 5 media) and found to have an average expression bin >2.0 is included in Table 3. Table 3 is sorted in order of descending $K_d$ in the unbuffered condition, with the highest values representing the lowest affinity of mouse IL-21 for mouse IL-21R.

TABLE 3

Mouse IL-21 Variants Comprising Single Amino Acid Substitutions

| Variant | Average expression bin | Affinity, pH 5 (nM) | Affinity, pH 6 (nM) | Affinity, pH 7 (nM) | Affinity, unbuffered (nM) |
|---|---|---|---|---|---|
| IL-21m_Y121L | 2.57 | 1.0E+04 | 3.8E+02 | 5.2E+01 | 5.5E+05 |
| IL-21m_L136G | 2.47 | 1.1E+05 | NA | 2.5E+02 | 4.4E+05 |
| IL-21m_L130G | 2.34 | 1.2E+05 | 6.5E+04 | NA | 3.9E+05 |
| IL-21m_P101W | 2.05 | 5.7E+04 | 5.6E+03 | 3.2E+02 | 3.5E+05 |
| IL-21m_L35G | 2.49 | 1.3E+05 | 5.8E+03 | 4.7E+02 | 3.4E+05 |
| IL-21m_M140E | 2.08 | 1.3E+04 | 1.7E+02 | 6.2E+01 | 3.3E+05 |
| IL-21m_L130K | 2.03 | 9.0E+04 | NA | NA | 3.3E+05 |
| IL-21m_Q95V | 2.02 | 4.7E+04 | 1.2E+02 | 3.5E+01 | 3.2E+05 |
| IL-21m_N85F | 2.56 | 2.8E+04 | 1.2E+03 | 1.5E+02 | 3.1E+05 |
| IL-21m_R98V | 2.19 | 3.6E+02 | 2.3E+01 | 4.1E+01 | 3.1E+05 |
| IL-21m_I38P | 2.72 | 1.3E+05 | 5.0E+04 | NA | 3.0E+05 |
| IL-21m_L137W | 2.47 | 1.1E+05 | 4.9E+03 | 8.9E+02 | 3.0E+05 |
| IL-21m_P101Y | 2.32 | 7.8E+04 | 9.5E+02 | 1.0E+02 | 2.9E+05 |
| IL-21m_F72G | 2.56 | 1.5E+05 | 8.0E+03 | 5.5E+02 | 2.9E+05 |
| IL-21m_LA2T | 2.44 | 5.7E+04 | 2.7E+03 | 2.7E+02 | 2.9E+05 |
| IL-21m_F72N | 2.61 | 7.3E+04 | 3.2E+04 | 6.1E+03 | 2.7E+05 |
| IL-21m_F69H | 2.36 | 4.1E+04 | 5.3E+03 | 3.5E+02 | 2.6E+05 |
| IL-21m_E40P | 2.39 | 2.8E+05 | 2.3E+04 | NA | 2.6E+05 |
| IL-21m_L100S | 2.46 | 1.0E+05 | 3.5E+03 | 2.7E+02 | 2.6E+05 |
| IL-21m_I38E | 2.51 | 1.0E+05 | 2.3E+05 | 5.3E+04 | 2.6E+05 |
| IL-21m_L92K | 2.24 | 3.2E+04 | 1.6E+02 | 5.9E+01 | 2.6E+05 |
| IL-21m_L92N | 2.41 | 7.8E+04 | 3.9E+02 | 6.9E+01 | 2.6E+05 |

TABLE 3-continued

Mouse IL-21 Variants Comprising Single Amino Acid Substitutions

| Variant | Average expression bin | Affinity, pH 5 (nM) | Affinity, pH 6 (nM) | Affinity, pH 7 (nM) | Affinity, unbuffered (nM) |
|---|---|---|---|---|---|
| IL-21m_L96T | 2.11 | 5.3E+04 | 5.5E+02 | 9.1E+01 | 2.5E+05 |
| IL-21m_A68N | 2.52 | 8.9E+04 | 6.4E+02 | 1.2E+02 | 2.5E+05 |
| IL-21m_I30P | 2.23 | 6.6E+04 | 1.1E+02 | 4.0E+01 | 2.5E+05 |
| IL-21m_P101T | 2.12 | 6.6E+04 | 5.0E+02 | 9.9E+01 | 2.5E+05 |
| IL-21m_Q73D | 2.21 | 3.7E+04 | 1.1E+04 | NA | 2.5E+05 |
| IL-21m_F69N | 2.48 | 1.1E+05 | 9.1E+03 | 3.0E+03 | 2.4E+05 |
| IL-21m_P101S | 2.12 | 9.4E+04 | 1.2E+03 | 1.0E+02 | 2.4E+05 |
| IL-21m_L137D | 2.15 | 7.0E+04 | 5.1E+04 | NA | 2.3E+05 |
| IL-21m_Q73G | 2.43 | 7.2E+03 | 5.2E+01 | 2.1E+01 | 2.3E+05 |
| IL-21m_F69R | 2.28 | 1.3E+05 | 5.0E+03 | 2.8E+03 | 2.3E+05 |
| IL-21m_F72W | 2.03 | 1.2E+05 | 3.3E+03 | 3.5E+02 | 2.3E+05 |
| IL-21m_L96N | 2.35 | 1.1E+05 | 4.5E+04 | NA | 2.3E+05 |
| IL-21m_L92Q | 2.58 | 8.7E+03 | 5.0E+01 | 2.9E+01 | 2.3E+05 |
| IL-21m_L137E | 2.18 | 3.0E+04 | 3.5E+03 | 6.8E+02 | 2.3E+05 |
| IL-21m_P101Q | 2.29 | 6.3E+04 | 1.1E+03 | 1.5E+02 | 2.2E+05 |
| IL-21m_F72P | 2.59 | 1.9E+05 | NA | 1.1E+04 | 2.2E+05 |
| IL-21m_I38W | 2.05 | 8.1E+04 | 1.1E+03 | 1.3E+02 | 2.2E+05 |
| IL-21m_I89W | 2.37 | 1.2E+05 | 2.7E+03 | 2.9E+02 | 2.2E+05 |
| IL-21m_LA2R | 2.38 | 1.8E+05 | 2.6E+04 | NA | 2.2E+05 |
| IL-21m_P101F | 2.09 | 8.8E+04 | 6.9E+03 | 5.7E+02 | 2.1E+05 |
| IL-21m_E122W | 2.36 | 2.6E+04 | 2.3E+02 | 6.5E+01 | 2.1E+05 |
| IL-21m_F129G | 2.29 | 5.3E+04 | 4.4E+02 | 5.9E+01 | 2.1E+05 |
| IL-21m_L32H | 2.69 | 9.6E+04 | 1.9E+04 | 8.6E+03 | 2.1E+05 |
| IL-21m_L100Q | 2.27 | 3.0E+05 | 1.2E+03 | 1.6E+02 | 2.0E+05 |
| IL-21m_L100H | 2.33 | 9.3E+04 | 3.1E+03 | 1.4E+02 | 2.0E+05 |
| IL-21m_V39Y | 2.03 | 8.8E+04 | 1.8E+03 | 2.1E+02 | 2.0E+05 |
| IL-21m_L77Y | 2.32 | 9.1E+04 | 1.5E+03 | 1.7E+02 | 2.0E+05 |
| IL-21m_P101K | 2.08 | 1.2E+05 | 9.2E+03 | 2.2E+02 | 2.0E+05 |
| IL-21m_LA9S | 2.35 | 8.6E+04 | 3.1E+04 | 8.2E+03 | 2.0E+05 |
| IL-21m_L35T | 2.5 | 9.6E+04 | 2.9E+02 | 8.2E+01 | 2.0E+05 |
| IL-21m_L42K | 2.41 | 1.9E+05 | 8.6E+04 | NA | 2.0E+05 |
| IL-21m_L136E | 2.41 | 1.5E+04 | 1.6E+02 | 4.9E+01 | 2.0E+05 |
| IL-21m_L54R | 2.21 | 1.0E+03 | 3.5E+01 | 1.7E+01 | 2.0E+05 |
| IL-21m_R98S | 2.4 | 2.4E+04 | 3.8E+01 | 5.0E+01 | 2.0E+05 |
| IL-21m_P79R | 2.35 | 1.1E+05 | 6.0E+02 | 9.4E+01 | 2.0E+05 |
| IL-21m_Q95R | 2.22 | 2.4E+04 | 2.9E+02 | 9.3E+01 | 2.0E+05 |
| IL-21m_F69D | 2.58 | 1.4E+05 | 1.1E+04 | 2.2E+03 | 2.0E+05 |
| IL-21m_L77Q | 2.44 | 7.9E+04 | 1.2E+04 | 3.3E+03 | 2.0E+05 |
| IL-21m_L77T | 2.31 | 1.2E+05 | 6.3E+04 | 2.5E+03 | 2.0E+05 |
| IL-21m_P57D | 2.39 | 6.3E+04 | 1.6E+04 | 1.7E+03 | 2.0E+05 |
| IL-21m_L42Q | 2.49 | 9.5E+04 | 1.4E+05 | NA | 1.9E+05 |
| IL-21m_P101M | 2.19 | 1.2E+05 | 1.8E+03 | 1.8E+02 | 1.9E+05 |
| IL-21m_P116W | 2.14 | 9.8E+03 | 7.9E+01 | 4.7E+01 | 1.9E+05 |
| IL-21m_L96G | 2.34 | 1.5E+05 | NA | 4.0E+03 | 1.9E+05 |
| IL-21m_L96D | 2.12 | 5.7E+04 | NA | NA | 1.9E+05 |
| IL-21m_F129Q | 2.15 | 3.1E+04 | 4.1E+03 | 5.5E+02 | 1.9E+05 |
| IL-21m_LA9R | 2.08 | 5.8E+04 | 2.2E+04 | NA | 1.9E+05 |
| IL-21m_A94P | 2.23 | 9.4E+04 | 8.4E+03 | 2.8E+02 | 1.9E+05 |
| IL-21m_A68D | 2.34 | 5.3E+04 | 6.4E+03 | 5.8E+02 | 1.9E+05 |
| IL-21m_L100Y | 2.06 | 9.4E+04 | 5.7E+02 | 1.3E+02 | 1.9E+05 |
| IL-21m_V39D | 2.46 | 1.2E+05 | 5.7E+04 | NA | 1.9E+05 |
| IL-21m_L54G | 2.36 | 1.5E+05 | 8.0E+02 | 1.3E+02 | 1.9E+05 |
| IL-21m_H34P | 2.29 | 1.0E+05 | 4.0E+04 | NA | 1.9E+05 |
| IL-21m_D37P | 2.46 | 9.1E+04 | 3.2E+02 | 8.8E+01 | 1.8E+05 |
| IL-21m_D26T | 2 | 7.9E+03 | 4.5E+01 | 2.0E+01 | 1.8E+05 |
| IL-21m_A68R | 2.32 | 6.3E+04 | 3.1E+03 | 8.0E+02 | 1.8E+05 |
| IL-21m_L100N | 2.33 | 1.1E+05 | 9.6E+02 | 1.2E+02 | 1.8E+05 |
| IL-21m_LA2Y | 2.27 | 1.4E+05 | 4.2E+04 | 1.2E+04 | 1.8E+05 |
| IL-21m_A70P | 2.33 | 6.7E+04 | 2.2E+03 | 1.6E+02 | 1.8E+05 |
| IL-21m_L77N | 2.25 | 6.5E+04 | 8.1E+03 | 2.8E+03 | 1.8E+05 |
| IL-21m_F129T | 2.18 | 5.9E+03 | 3.8E+01 | 2.3E+01 | 1.8E+05 |
| IL-21m_L35D | 2.68 | 8.8E+03 | 1.3E+02 | 8.0E+01 | 1.8E+05 |
| IL-21m_P101E | 2.15 | 6.1E+04 | 6.6E+02 | 2.2E+02 | 1.8E+05 |
| IL-21m_E65P | 2.53 | 6.6E+04 | 2.2E+03 | 1.1E+02 | 1.8E+05 |
| IL-21m_F72R | 2.48 | 5.3E+04 | 6.2E+03 | 2.7E+03 | 1.8E+05 |
| IL-21m_L100W | 2.26 | 5.4E+04 | 1.7E+02 | 5.8E+01 | 1.8E+05 |
| IL-21m_LA9K | 2.43 | 9.1E+04 | 3.4E+04 | NA | 1.8E+05 |
| IL-21m_Q138P | 2.01 | 4.7E+04 | 1.1E+03 | 1.9E+02 | 1.8E+05 |
| IL-21m_K74P | 2.2 | 1.2E+05 | 2.3E+03 | 1.7E+02 | 1.8E+05 |
| IL-21m_I141D | 2.2 | 8.6E+04 | 5.8E+02 | 1.0E+02 | 1.8E+05 |
| IL-21m_L35K | 2.55 | 1.1E+05 | NA | 3.6E+02 | 1.8E+05 |
| IL-21m_R98E | 2.15 | 1.9E+04 | 3.9E+02 | 5.0E+02 | 1.8E+05 |
| IL-21m_F69G | 2.58 | 3.5E+04 | 7.1E+03 | NA | 1.8E+05 |
| IL-21m_LA9P | 2.22 | 8.6E+04 | 5.4E+04 | 1.9E+04 | 1.8E+05 |

TABLE 3-continued

Mouse IL-21 Variants Comprising Single Amino Acid Substitutions

| Variant | Average expression bin | Affinity, pH 5 (nM) | Affinity, pH 6 (nM) | Affinity, pH 7 (nM) | Affinity, unbuffered (nM) |
|---|---|---|---|---|---|
| IL-21m__F69P | 2.57 | 2.4E+05 | 2.0E+04 | 2.3E+04 | 1.8E+05 |
| IL-21m__E46P | 2.11 | 3.3E+04 | 2.2E+02 | 6.6E+01 | 1.7E+05 |
| IL-21m__I38Y | 2.29 | 1.8E+05 | 2.3E+03 | 2.3E+02 | 1.7E+05 |
| IL-21m__L137Y | 2.34 | 2.6E+04 | 2.4E+03 | 7.5E+02 | 1.7E+05 |
| IL-21m__V93H | 2.24 | 6.7E+04 | 4.1E+02 | 4.1E+01 | 1.7E+05 |
| IL-21m__L96A | 2.12 | 8.2E+04 | 4.2E+03 | 2.7E+02 | 1.7E+05 |
| IL-21m__LA2H | 2.49 | 8.9E+04 | 9.2E+03 | 2.4E+03 | 1.7E+05 |
| IL-21m__K139P | 2.04 | 6.2E+04 | 3.8E+03 | 6.1E+02 | 1.7E+05 |
| IL-21m__V60Q | 2.15 | 2.6E+04 | 2.9E+02 | 6.6E+01 | 1.7E+05 |
| IL-21m__E128N | 2.4 | 4.8E+04 | 7.6E+02 | 1.0E+02 | 1.7E+05 |
| IL-21m__P57H | 2.07 | 6.6E+04 | 6.0E+03 | 1.6E+03 | 1.7E+05 |
| IL-21m__E128P | 2.11 | 7.2E+04 | 6.7E+03 | 3.2E+02 | 1.7E+05 |
| IL-21m__A56G | 2.11 | 2.2E+04 | 1.3E+02 | 3.7E+01 | 1.7E+05 |
| IL-21m__F129D | 2.3 | 5.2E+04 | NA | 9.2E+03 | 1.7E+05 |
| IL-21m__N85L | 2.38 | 7.6E+04 | 4.4E+03 | 4.6E+02 | 1.7E+05 |
| IL-21m__F69T | 2.35 | 2.7E+05 | NA | NA | 1.7E+05 |
| IL-21m__L136P | 2.19 | 4.5E+04 | 1.0E+04 | 2.6E+03 | 1.7E+05 |
| IL-21m__LA2S | 2.39 | 1.5E+05 | 5.0E+04 | 1.1E+04 | 1.7E+05 |
| IL-21m__A68P | 2.35 | 9.1E+04 | 4.8E+03 | 1.6E+03 | 1.7E+05 |
| IL-21m__L100T | 2.34 | 2.4E+04 | 8.8E+01 | 4.7E+01 | 1.7E+05 |
| IL-21m__I30S | 2.09 | 1.4E+05 | 1.7E+02 | 4.2E+01 | 1.7E+05 |
| IL-21m__L137G | 2.27 | 6.8E+04 | 1.5E+03 | 3.0E+02 | 1.7E+05 |
| IL-21m__P101G | 2.16 | 9.8E+04 | 1.5E+03 | 3.0E+02 | 1.7E+05 |
| IL-21m__A56P | 2.09 | 2.3E+04 | 2.2E+02 | 4.8E+01 | 1.7E+05 |
| IL-21m__Q73F | 2.2 | 7.0E+04 | 2.1E+03 | 3.4E+02 | 1.7E+05 |
| IL-21m__L137F | 2.18 | 4.6E+04 | 5.8E+02 | 9.7E+01 | 1.7E+05 |
| IL-21m__L32D | 2.87 | 9.1E+04 | 6.0E+03 | 3.2E+03 | 1.6E+05 |
| IL-21m__L77G | 2.42 | 1.3E+05 | 2.7E+04 | NA | 1.6E+05 |
| IL-21m__LA9G | 2.28 | 8.5E+04 | 3.5E+04 | 1.7E+04 | 1.6E+05 |
| IL-21m__E128R | 2.26 | 5.9E+04 | 3.8E+02 | 8.7E+01 | 1.6E+05 |
| IL-21m__L92R | 2.33 | 1.8E+04 | 6.0E+01 | 2.8E+01 | 1.6E+05 |
| IL-21m__F69Q | 2.53 | 9.7E+04 | 2.4E+04 | 1.3E+04 | 1.6E+05 |
| IL-21m__F69A | 2.63 | 4.2E+04 | 5.1E+02 | 8.0E+01 | 1.6E+05 |
| IL-21m__E131P | 2 | 1.4E+04 | 2.2E+02 | 5.1E+01 | 1.6E+05 |
| IL-21m__P116F | 2.04 | 3.1E+03 | 4.8E+01 | 3.0E+01 | 1.6E+05 |
| IL-21m__F129N | 2.19 | 9.7E+05 | 4.0E+03 | 1.0E+03 | 1.6E+05 |
| IL-21m__LA9T | 2.54 | 7.9E+04 | 3.4E+02 | 1.0E+02 | 1.6E+05 |
| IL-21m__N85I | 2.36 | 1.3E+05 | 3.7E+03 | 3.2E+02 | 1.6E+05 |
| IL-21m__L100A | 2.39 | 1.1E+05 | 4.6E+02 | 6.1E+01 | 1.6E+05 |
| IL-21m__L100G | 2.39 | 4.0E+04 | 3.3E+03 | 5.0E+02 | 1.6E+05 |
| IL-21m__M140N | 2.07 | 5.8E+04 | 3.7E+02 | 6.9E+01 | 1.6E+05 |
| IL-21m__Q73E | 2.43 | 3.9E+04 | 5.0E+02 | 1.1E+02 | 1.6E+05 |
| IL-21m__F129I | 2.16 | 9.6E+04 | 4.7E+02 | 1.3E+02 | 1.6E+05 |
| IL-21m__Q95E | 2.09 | 5.9E+02 | 2.6E+01 | 2.9E+01 | 1.6E+05 |
| IL-21m__L133D | 2.32 | 4.0E+05 | 2.4E+04 | 1.1E+04 | 1.6E+05 |
| IL-21m__I38D | 2.57 | 1.4E+05 | 4.1E+03 | 8.0E+02 | 1.6E+05 |
| IL-21m__Q143P | 2.51 | 9.3E+03 | 9.2E+01 | 3.1E+01 | 1.6E+05 |
| IL-21m__F69E | 2.66 | 6.5E+04 | 8.1E+03 | 1.9E+03 | 1.6E+05 |
| IL-21m__L100E | 2.32 | 7.6E+04 | 1.0E+03 | 2.6E+02 | 1.5E+05 |
| IL-21m__V39G | 2.34 | 1.3E+05 | 2.4E+03 | 2.4E+02 | 1.5E+05 |
| IL-21m__L35Q | 2.44 | 5.1E+04 | 4.2E+02 | 1.1E+02 | 1.5E+05 |
| IL-21m__P57K | 2.06 | 2.6E+05 | 6.9E+04 | 6.7E+03 | 1.5E+05 |
| IL-21m__I38Q | 2.43 | 1.1E+05 | 3.6E+03 | 3.1E+02 | 1.5E+05 |
| IL-21m__P57N | 2.02 | 8.4E+04 | 1.3E+04 | 7.7E+03 | 1.5E+05 |
| IL-21m__P101H | 2.12 | 1.7E+05 | 9.2E+02 | 1.2E+02 | 1.5E+05 |
| IL-21m__V93R | 2.09 | 2.1E+03 | 4.7E+01 | 1.6E+01 | 1.5E+05 |
| IL-21m__P126D | 2.25 | 2.0E+05 | 9.4E+04 | NA | 1.5E+05 |
| IL-21m__L77D | 2.37 | 9.7E+04 | NA | NA | 1.5E+05 |
| IL-21m__L137Q | 2.03 | 5.4E+04 | 7.4E+03 | 2.5E+03 | 1.5E+05 |
| IL-21m__R97P | 2.18 | 7.8E+04 | 2.4E+02 | 7.9E+01 | 1.5E+05 |
| IL-21m__A75R | 2.59 | 5.0E+05 | 1.3E+04 | 3.6E+02 | 1.5E+05 |
| IL-21m__P101V | 2.26 | 8.5E+04 | 4.4E+02 | 9.5E+01 | 1.5E+05 |
| IL-21m__K43P | 2.27 | 1.0E+05 | 1.2E+04 | 3.0E+03 | 1.5E+05 |
| IL-21m__L32E | 2.68 | 1.3E+05 | 2.1E+04 | 1.0E+04 | 1.5E+05 |
| IL-21m__L136R | 2.19 | 5.4E+04 | 2.3E+02 | 5.5E+01 | 1.5E+05 |
| IL-21m__R98W | 2.15 | 4.1E+03 | 4.1E+01 | 5.7E+01 | 1.5E+05 |
| IL-21m__M140R | 2.01 | 5.4E+04 | 2.2E+02 | 4.5E+01 | 1.5E+05 |
| IL-21m__L77S | 2.18 | 5.3E+04 | 7.4E+03 | 2.2E+03 | 1.5E+05 |
| IL-21m__V93K | 2.07 | 9.1E+04 | 2.6E+03 | 2.0E+02 | 1.5E+05 |
| IL-21m__D26G | 2.39 | 9.7E+03 | 8.2E+01 | 3.1E+01 | 1.5E+05 |
| IL-21m__LA9H | 2.19 | 2.7E+05 | 3.0E+04 | 1.8E+04 | 1.5E+05 |
| IL-21m__P126Q | 2.16 | 4.5E+04 | 4.4E+02 | 1.7E+02 | 1.5E+05 |
| IL-21m__Q73R | 2.21 | 3.8E+03 | 4.1E+01 | 1.3E+01 | 1.5E+05 |
| IL-21m__I89D | 2.33 | 6.9E+04 | 1.9E+03 | 1.6E+02 | 1.5E+05 |

TABLE 3-continued

Mouse IL-21 Variants Comprising Single Amino Acid Substitutions

| Variant | Average expression bin | Affinity, pH 5 (nM) | Affinity, pH 6 (nM) | Affinity, pH 7 (nM) | Affinity, unbuffered (nM) |
|---|---|---|---|---|---|
| IL-21m_Y121P | 2.32 | 5.0E+04 | 1.1E+03 | 1.5E+02 | 1.5E+05 |
| IL-21m_F129H | 2.4 | 3.5E+04 | 2.4E+02 | 5.6E+01 | 1.5E+05 |
| IL-21m_R98Y | 2.43 | 1.4E+02 | 1.5E+01 | 4.0E+01 | 1.5E+05 |
| IL-21m_L77K | 2.12 | 1.2E+05 | NA | NA | 1.5E+05 |
| IL-21m_P57T | 2.1 | 8.5E+04 | 1.2E+04 | 8.7E+02 | 1.5E+05 |
| IL-21m_Q41P | 2.27 | 8.4E+04 | 6.0E+04 | 2.9E+04 | 1.5E+05 |
| IL-21m_R33P | 2.38 | 1.5E+05 | 5.1E+04 | 6.5E+03 | 1.5E+05 |
| IL-21m_Q73P | 2.32 | 7.1E+04 | 1.9E+04 | 8.8E+03 | 1.5E+05 |
| IL-21m_D26Q | 2.31 | 8.8E+03 | 4.4E+01 | 2.1E+01 | 1.5E+05 |
| IL-21m_R98G | 2.46 | 9.7E+04 | 7.8E+02 | 1.9E+02 | 1.5E+05 |
| IL-21m_LA9D | 2.31 | 1.4E+05 | 2.4E+04 | 1.3E+04 | 1.5E+05 |
| IL-21m_D26H | 2.62 | 2.2E+04 | 8.3E+01 | 2.9E+01 | 1.5E+05 |
| IL-21m_V60N | 2.04 | 4.2E+04 | 2.9E+02 | 7.2E+01 | 1.5E+05 |
| IL-21m_L130V | 2.35 | 1.1E+04 | 1.3E+02 | 4.8E+01 | 1.5E+05 |
| IL-21m_L137S | 2.1 | 5.0E+04 | 2.7E+02 | 5.7E+01 | 1.5E+05 |
| IL-21m_L32T | 2.46 | 1.0E+05 | NA | 2.6E+03 | 1.4E+05 |
| IL-21m_L96K | 2.16 | 2.3E+05 | NA | NA | 1.4E+05 |
| IL-21m_M140G | 2.24 | 3.5E+04 | 1.8E+03 | 1.9E+02 | 1.4E+05 |
| IL-21m_Y45P | 2.26 | 6.1E+04 | 1.5E+04 | 2.4E+03 | 1.4E+05 |
| IL-21m_Q73H | 2.12 | 3.3E+04 | 2.5E+02 | 5.2E+01 | 1.4E+05 |
| IL-21m_LA9E | 2.39 | 7.4E+04 | 2.8E+04 | 3.2E+04 | 1.4E+05 |
| IL-21m_L92P | 2.31 | 1.3E+05 | 2.6E+04 | NA | 1.4E+05 |
| IL-21m_L100F | 2.25 | 1.5E+04 | 6.6E+01 | 4.4E+01 | 1.4E+05 |
| IL-21m_M140T | 2.25 | 9.1E+03 | 9.8E+01 | 4.1E+01 | 1.4E+05 |
| IL-21m_L100K | 2.03 | 9.0E+04 | 2.1E+04 | 6.6E+02 | 1.4E+05 |
| IL-21m_M140P | 2.14 | 3.9E+04 | 3.9E+03 | 1.1E+03 | 1.4E+05 |
| IL-21m_R98A | 2 | 6.4E+03 | 4.9E+01 | 4.9E+01 | 1.4E+05 |
| IL-21m_D26P | 2.32 | 5.0E+03 | 3.8E+01 | 1.6E+01 | 1.4E+05 |
| IL-21m_F129K | 2.06 | 4.5E+04 | NA | NA | 1.4E+05 |
| IL-21m_I38H | 2.42 | 8.3E+04 | 4.9E+03 | 2.4E+02 | 1.4E+05 |
| IL-21m_V39E | 2.51 | 1.7E+05 | 2.7E+03 | 7.6E+02 | 1.4E+05 |
| IL-21m_L136D | 2.29 | 1.6E+05 | 1.8E+03 | 1.8E+02 | 1.4E+05 |
| IL-21m_N85W | 2.23 | 1.3E+05 | 1.3E+04 | NA | 1.4E+05 |
| IL-21m_L130A | 2.05 | 9.6E+04 | 1.1E+04 | 1.1E+03 | 1.4E+05 |
| IL-21m_P57E | 2.14 | 8.5E+04 | 1.3E+04 | 1.8E+03 | 1.4E+05 |
| IL-21m_L29P | 2.28 | 1.5E+04 | 1.1E+02 | 3.7E+01 | 1.4E+05 |
| IL-21m_L54D | 2.39 | 3.0E+04 | 2.3E+02 | 6.0E+01 | 1.4E+05 |
| IL-21m_I38R | 2.49 | 8.7E+04 | NA | NA | 1.4E+05 |
| IL-21m_L137P | 2.14 | 5.1E+04 | 8.5E+03 | 2.5E+03 | 1.4E+05 |
| IL-21m_R98P | 2.23 | 2.0E+05 | 1.9E+03 | 6.1E+02 | 1.4E+05 |
| IL-21m_Q41G | 2.06 | 1.3E+04 | 4.6E+01 | 2.6E+01 | 1.4E+05 |
| IL-21m_F72D | 2.62 | 1.2E+05 | NA | NA | 1.4E+05 |
| IL-21m_L35H | 2.5 | 2.3E+05 | 6.0E+02 | 1.1E+02 | 1.4E+05 |
| IL-21m_H34R | 2.03 | 3.3E+04 | 4.3E+02 | 8.0E+01 | 1.4E+05 |
| IL-21m_L96R | 2.19 | 6.1E+04 | NA | NA | 1.4E+05 |
| IL-21m_V39N | 2.48 | 8.3E+04 | 3.8E+03 | 5.0E+02 | 1.4E+05 |
| IL-21m_L92H | 2.36 | 4.7E+04 | 7.8E+01 | 2.1E+01 | 1.4E+05 |
| IL-21m_L77H | 2.12 | 8.3E+04 | NA | NA | 1.4E+05 |
| IL-21m_I38F | 2.16 | 1.2E+05 | 1.4E+03 | 1.8E+02 | 1.4E+05 |
| IL-21m_L32G | 2.67 | 1.4E+05 | 5.7E+04 | NA | 1.4E+05 |
| IL-21m_L42W | 2.1 | 1.3E+05 | 4.4E+04 | 4.6E+04 | 1.4E+05 |
| IL-21m_A56K | 2.61 | 1.8E+05 | 5.7E+03 | 1.5E+03 | 1.4E+05 |
| IL-21m_I38S | 2.27 | 7.0E+03 | 7.7E+01 | 4.3E+01 | 1.3E+05 |
| IL-21m_L133E | 2.13 | 7.7E+03 | 8.2E+01 | 8.3E+01 | 1.3E+05 |
| IL-21m_I38G | 2.67 | 1.1E+05 | 5.5E+03 | 3.9E+02 | 1.3E+05 |
| IL-21m_A56E | 2.66 | 6.0E+04 | 4.7E+03 | 1.4E+03 | 1.3E+05 |
| IL-21m_L49Q | 2.46 | 7.2E+04 | 6.0E+04 | NA | 1.3E+05 |
| IL-21m_P101L | 2.08 | 5.4E+04 | 4.3E+03 | 2.3E+02 | 1.3E+05 |
| IL-21m_F69S | 2.72 | 1.0E+05 | 1.2E+04 | NA | 1.3E+05 |
| IL-21m_I36P | 2.69 | 1.6E+05 | NA | NA | 1.3E+05 |
| IL-21m_I141R | 2.15 | 1.2E+04 | 1.3E+02 | 3.5E+01 | 1.3E+05 |
| IL-21m_E128S | 2.43 | 2.5E+04 | 2.4E+02 | 5.9E+01 | 1.3E+05 |
| IL-21m_L137R | 2.07 | 3.3E+04 | 2.0E+03 | 4.9E+02 | 1.3E+05 |
| IL-21m_I30R | 2.1 | 2.3E+05 | 3.4E+02 | 4.2E+01 | 1.3E+05 |
| IL-21m_D26Y | 2.38 | 1.3E+04 | 9.8E+01 | 2.8E+01 | 1.3E+05 |
| IL-21m_R31K | 2.29 | 1.1E+05 | 7.6E+04 | 1.0E+04 | 1.3E+05 |
| IL-21m_R98N | 2.42 | 5.0E+04 | 9.3E+01 | 6.6E+01 | 1.3E+05 |
| IL-21m_L32R | 2.67 | 7.3E+04 | 6.1E+03 | 1.9E+03 | 1.3E+05 |
| IL-21m_L29R | 2.28 | 3.7E+03 | 4.4E+01 | 1.9E+01 | 1.3E+05 |
| IL-21m_L92S | 2.53 | 1.1E+04 | 4.7E+01 | 3.1E+01 | 1.3E+05 |
| IL-21m_L92G | 2.46 | 2.1E+04 | 8.1E+01 | 5.0E+01 | 1.3E+05 |
| IL-21m_P101A | 2.02 | 8.2E+04 | 1.1E+03 | 2.0E+02 | 1.3E+05 |
| IL-21m_F69K | 2.27 | 4.9E+04 | 2.0E+04 | NA | 1.3E+05 |
| IL-21m_LA2G | 2.52 | 1.9E+05 | 3.3E+04 | NA | 1.3E+05 |

TABLE 3-continued

Mouse IL-21 Variants Comprising Single Amino Acid Substitutions

| Variant | Average expression bin | Affinity, pH 5 (nM) | Affinity, pH 6 (nM) | Affinity, pH 7 (nM) | Affinity, unbuffered (nM) |
|---|---|---|---|---|---|
| IL-21m_H34S | 2.38 | 6.1E+02 | 3.2E+01 | 3.7E+01 | 1.3E+05 |
| IL-21m_L35S | 2.47 | 1.2E+05 | 5.1E+02 | 1.0E+02 | 1.3E+05 |
| IL-21m_L133P | 2.03 | 4.1E+04 | 6.7E+03 | 1.9E+03 | 1.3E+05 |
| IL-21m_Q95T | 2.2 | 1.4E+04 | 4.0E+01 | 4.0E+01 | 1.3E+05 |
| IL-21m_M140S | 2.19 | 8.9E+03 | 6.8E+01 | 3.3E+01 | 1.3E+05 |
| IL-21m_LA2N | 2.54 | 1.3E+05 | 1.4E+04 | 3.0E+03 | 1.3E+05 |
| IL-21m_N85V | 2.38 | 1.9E+04 | 2.9E+02 | 5.8E+01 | 1.3E+05 |
| IL-21m_LA9A | 2.28 | 1.2E+05 | 9.9E+03 | 1.5E+04 | 1.3E+05 |
| IL-21m_Q95W | 2.24 | 1.2E+05 | 9.0E+03 | 8.2E+02 | 1.3E+05 |
| IL-21m_I89E | 2.28 | 9.3E+04 | 8.8E+02 | 2.0E+02 | 1.3E+05 |
| IL-21m_M140Y | 2.42 | 6.9E+03 | 1.2E+02 | 5.3E+01 | 1.3E+05 |
| IL-21m_L32V | 2.39 | 2.2E+04 | 1.6E+02 | 6.2E+01 | 1.3E+05 |
| IL-21m_F72H | 2.54 | 2.6E+05 | 2.3E+04 | 4.1E+03 | 1.3E+05 |
| IL-21m_F129R | 2.04 | 1.3E+05 | 3.1E+04 | 3.8E+03 | 1.3E+05 |
| IL-21m_L136S | 2.42 | 5.8E+03 | 1.0E+02 | 3.2E+01 | 1.3E+05 |
| IL-21m_R27G | 2.2 | 7.4E+04 | 5.3E+01 | 3.2E+01 | 1.3E+05 |
| IL-21m_L35P | 2.68 | 1.5E+05 | 2.7E+04 | 1.1E+04 | 1.3E+05 |
| IL-21m_A56Q | 2.01 | 7.9E+04 | 4.2E+03 | 2.1E+02 | 1.3E+05 |
| IL-21m_L32A | 2.67 | 1.4E+05 | 1.4E+03 | 1.9E+02 | 1.3E+05 |
| IL-21m_S80P | 2.3 | 3.0E+03 | 4.3E+01 | 2.1E+01 | 1.3E+05 |
| IL-21m_Y121I | 2.43 | 9.8E+03 | 1.2E+02 | 3.5E+01 | 1.3E+05 |
| IL-21m_R98F | 2.26 | 2.9E+02 | 2.5E+01 | 4.4E+01 | 1.2E+05 |
| IL-21m_F129P | 2.11 | 1.8E+05 | 2.2E+04 | NA | 1.2E+05 |
| IL-21m_P79K | 2.21 | 9.6E+03 | 2.6E+02 | 8.3E+01 | 1.2E+05 |
| IL-21m_V39H | 2.27 | 1.6E+05 | 1.8E+04 | 6.0E+02 | 1.2E+05 |
| IL-21m_L96S | 2.23 | 1.1E+05 | 2.7E+04 | 3.3E+03 | 1.2E+05 |
| IL-21m_L77R | 2.19 | 1.2E+05 | 1.5E+04 | 1.7E+04 | 1.2E+05 |
| IL-21m_L42V | 2.28 | 9.8E+03 | 7.6E+01 | 3.5E+01 | 1.2E+05 |
| IL-21m_L32K | 2.68 | 9.7E+04 | 2.1E+04 | 7.0E+03 | 1.2E+05 |
| IL-21m_L77E | 2.62 | 4.8E+04 | 5.2E+03 | 2.5E+03 | 1.2E+05 |
| IL-21m_I141S | 2.22 | 8.4E+03 | 8.6E+01 | 2.4E+01 | 1.2E+05 |
| IL-21m_LA2P | 2.74 | 1.3E+05 | 1.1E+05 | NA | 1.2E+05 |
| IL-21m_I38K | 2.43 | 6.9E+04 | 3.9E+04 | 7.6E+02 | 1.2E+05 |
| IL-21m_L133H | 2.01 | 7.6E+04 | 4.0E+03 | 1.1E+02 | 1.2E+05 |
| IL-21m_I89P | 2.37 | 3.6E+03 | 2.9E+01 | 1.8E+01 | 1.2E+05 |
| IL-21m_P126W | 2.19 | 2.5E+05 | NA | NA | 1.2E+05 |
| IL-21m_V60K | 2.09 | 7.8E+04 | 2.5E+03 | 2.0E+02 | 1.2E+05 |
| IL-21m_E128W | 2.37 | 4.2E+04 | 5.0E+02 | 9.3E+01 | 1.2E+05 |
| IL-21m_F72Q | 2.61 | 5.6E+04 | 4.1E+03 | 6.1E+02 | 1.2E+05 |
| IL-21m_L32N | 2.7 | 1.5E+05 | NA | 1.3E+04 | 1.2E+05 |
| IL-21m_R98I | 2.18 | 4.4E+03 | 4.2E+01 | 3.5E+01 | 1.2E+05 |
| IL-21m_A68K | 2.19 | 1.4E+05 | 1.9E+04 | 3.7E+03 | 1.2E+05 |
| IL-21m_LA9N | 2.31 | 7.2E+04 | 2.5E+04 | NA | 1.2E+05 |
| IL-21m_I44P | 2.61 | 1.9E+03 | 2.3E+01 | 1.6E+01 | 1.2E+05 |
| IL-21m_Q95D | 2.16 | 3.5E+03 | 3.4E+01 | 2.5E+01 | 1.2E+05 |
| IL-21m_L35E | 2.55 | 6.1E+04 | 4.7E+03 | 1.6E+03 | 1.2E+05 |
| IL-21m_I89T | 2.31 | 1.2E+04 | 1.0E+02 | 3.3E+01 | 1.2E+05 |
| IL-21m_L96P | 2.27 | 1.0E+05 | 4.2E+04 | NA | 1.2E+05 |
| IL-21m_V39R | 2.45 | 9.0E+04 | 1.1E+04 | 2.9E+03 | 1.2E+05 |
| IL-21m_LA2E | 2.39 | 6.9E+04 | 7.5E+03 | 1.8E+03 | 1.2E+05 |
| IL-21m_V39P | 2.45 | 8.8E+04 | 3.9E+04 | NA | 1.2E+05 |
| IL-21m_L92T | 2.22 | 1.2E+04 | 8.7E+01 | 3.8E+01 | 1.2E+05 |
| IL-21m_H34D | 2.11 | 8.5E+03 | 3.0E+02 | 1.9E+02 | 1.2E+05 |
| IL-21m_L130W | 2.33 | 4.3E+04 | 2.4E+03 | 5.6E+02 | 1.2E+05 |
| IL-21m_L100D | 2.1 | 2.1E+05 | 3.0E+04 | 1.3E+03 | 1.2E+05 |
| IL-21m_L137A | 2.11 | 4.8E+03 | 4.1E+01 | 3.0E+01 | 1.2E+05 |
| IL-21m_S120P | 2.08 | 4.6E+04 | 2.6E+02 | 5.0E+01 | 1.2E+05 |
| IL-21m_L32Q | 2.64 | 1.4E+05 | 2.4E+04 | 2.9E+03 | 1.2E+05 |
| IL-21m_F129E | 2.11 | 7.4E+04 | 2.3E+04 | 2.0E+04 | 1.2E+05 |
| IL-21m_L35N | 2.61 | 5.5E+03 | 3.4E+01 | 3.0E+01 | 1.2E+05 |
| IL-21m_I89G | 2.36 | 4.2E+04 | 4.8E+03 | 2.6E+02 | 1.1E+05 |
| IL-21m_I89F | 2.32 | 7.8E+03 | 1.4E+02 | 4.3E+01 | 1.1E+05 |
| IL-21m_L130D | 2.03 | 3.4E+04 | 6.8E+03 | 1.6E+03 | 1.1E+05 |
| IL-21m_M140Q | 2.17 | 3.3E+03 | 4.5E+01 | 2.3E+01 | 1.1E+05 |
| IL-21m_R98D | 2.32 | 1.3E+05 | 2.1E+04 | NA | 1.1E+05 |
| IL-21m_R132W | 2.29 | 3.9E+04 | 2.3E+02 | 5.1E+01 | 1.1E+05 |
| IL-21m_L77P | 2.57 | 1.4E+04 | 1.7E+02 | 5.7E+01 | 1.1E+05 |
| IL-21m_I89R | 2.01 | 1.0E+05 | 5.0E+03 | 6.6E+02 | 1.1E+05 |
| IL-21m_H142P | 2.4 | 4.1E+04 | 9.4E+02 | 1.4E+02 | 1.1E+05 |
| IL-21m_L32P | 2.73 | 7.8E+04 | 9.4E+03 | 2.0E+03 | 1.1E+05 |
| IL-21m_L96H | 2.06 | 4.8E+04 | 2.0E+04 | NA | 1.1E+05 |
| IL-21m_L32W | 2.22 | 3.3E+03 | 3.3E+01 | 1.6E+01 | 1.1E+05 |
| IL-21m_V39Q | 2.12 | 1.8E+04 | 4.7E+02 | 1.1E+02 | 1.1E+05 |
| IL-21m_L35R | 2.33 | 1.2E+05 | NA | NA | 1.1E+05 |

TABLE 3-continued

| Mouse IL-21 Variants Comprising Single Amino Acid Substitutions | | | | | |
|---|---|---|---|---|---|
| Variant | Average expression bin | Affinity, pH 5 (nM) | Affinity, pH 6 (nM) | Affinity, pH 7 (nM) | Affinity, unbuffered (nM) |
| IL-21m_L54P | 2.26 | 5.3E+04 | 8.8E+03 | 7.3E+02 | 1.1E+05 |
| IL-21m_D26K | 2.26 | 7.4E+03 | 5.5E+01 | 1.8E+01 | 1.1E+05 |
| IL-21m_L35F | 2.09 | 2.3E+03 | 2.4E+01 | 1.6E+01 | 1.1E+05 |
| IL-21m_F72E | 2.65 | 7.1E+04 | 1.5E+04 | NA | 1.1E+05 |
| IL-21m_L136K | 2.22 | 3.2E+04 | 1.4E+03 | 1.3E+02 | 1.1E+05 |
| IL-21m_F72S | 2.56 | 2.8E+05 | 2.0E+03 | 2.0E+02 | 1.1E+05 |
| IL-21m_R27N | 2.02 | 2.1E+05 | 9.8E+01 | 4.5E+01 | 1.1E+05 |
| IL-21m_R31L | 2.43 | 9.8E+04 | 1.6E+04 | 3.3E+03 | 1.1E+05 |
| IL-21m_V39K | 2.44 | 1.1E+05 | 2.1E+04 | 1.3E+04 | 1.1E+05 |
| IL-21m_L92A | 2.28 | 2.1E+03 | 1.9E+01 | 1.7E+01 | 1.1E+05 |
| IL-21m_K78P | 2.23 | 5.0E+04 | 6.3E+02 | 8.8E+01 | 1.1E+05 |
| IL-21m_LA2A | 2.38 | 1.6E+05 | 6.6E+02 | 9.9E+01 | 1.1E+05 |
| IL-21m_D119P | 2.05 | 3.5E+03 | 6.5E+01 | 2.5E+01 | 1.1E+05 |
| IL-21m_R98T | 2.39 | 4.6E+04 | 5.5E+01 | 3.1E+01 | 1.1E+05 |
| IL-21m_A75D | 2.41 | 2.6E+04 | 1.8E+02 | 5.7E+01 | 1.1E+05 |
| IL-21m_A56D | 2.05 | 5.2E+04 | 7.6E+03 | 1.3E+03 | 1.1E+05 |
| IL-21m_R27S | 2.12 | 3.1E+04 | 3.0E+01 | 2.5E+01 | 1.1E+05 |
| IL-21m_L92D | 2.37 | 1.6E+05 | 1.4E+04 | 3.0E+03 | 1.1E+05 |
| IL-21m_A68E | 2.49 | 2.5E+04 | 4.3E+02 | 1.1E+02 | 1.1E+05 |
| IL-21m_R27K | 2.55 | 2.4E+04 | 6.9E+01 | 3.7E+01 | 1.0E+05 |
| IL-21m_M140V | 2.12 | 1.9E+04 | 1.3E+02 | 3.5E+01 | 1.0E+05 |
| IL-21m_Y45D | 2.31 | 1.7E+04 | 2.5E+02 | 6.3E+01 | 1.0E+05 |
| IL-21m_V93N | 2.38 | 6.6E+03 | 5.1E+01 | 2.7E+01 | 1.0E+05 |
| IL-21m_P57A | 2.01 | 7.8E+03 | 8.0E+01 | 3.7E+01 | 1.0E+05 |
| IL-21m_Y121K | 2.43 | 5.9E+04 | 6.8E+02 | 1.0E+02 | 1.0E+05 |
| IL-21m_Y121D | 2.49 | 8.6E+03 | 8.5E+01 | 6.2E+01 | 1.0E+05 |
| IL-21m_I89H | 2.14 | 6.0E+04 | 1.8E+03 | 8.9E+01 | 1.0E+05 |
| IL-21m_P25K | 2 | 6.6E+02 | 1.6E+01 | 7.0E+00 | 1.0E+05 |
| IL-21m_I38N | 2.58 | 1.6E+04 | 6.7E+01 | 3.5E+01 | 1.0E+05 |
| IL-21m_Q41D | 2.38 | 5.0E+03 | 4.1E+01 | 3.3E+01 | 1.0E+05 |
| IL-21m_I89K | 2.3 | 1.8E+05 | 1.0E+04 | 1.9E+03 | 1.0E+05 |
| IL-21m_P126S | 2.04 | 6.9E+03 | 8.1E+01 | 4.8E+01 | 1.0E+05 |
| IL-21m_S117F | 2.15 | 4.2E+03 | 5.7E+01 | 4.6E+01 | 1.0E+05 |
| IL-21m_A75K | 2.2 | 4.5E+04 | 5.5E+02 | 9.2E+01 | 9.9E+04 |
| IL-21m_H34G | 2.28 | 2.9E+03 | 5.5E+01 | 5.4E+01 | 9.9E+04 |
| IL-21m_A68T | 2.25 | 2.9E+03 | 4.2E+01 | 2.4E+01 | 9.9E+04 |
| IL-21m_V60D | 2.31 | 1.4E+04 | 9.4E+01 | 4.5E+01 | 9.9E+04 |
| IL-21m_I89S | 2.42 | 4.0E+04 | 1.2E+03 | 9.1E+01 | 9.9E+04 |
| IL-21m_A68H | 2.19 | 4.4E+04 | 1.9E+03 | 1.6E+02 | 9.8E+04 |
| IL-21m_R97W | 2.13 | 4.8E+04 | 3.6E+02 | 1.1E+02 | 9.8E+04 |
| IL-21m_Q73L | 2.07 | 2.5E+03 | 4.1E+01 | 2.6E+01 | 9.8E+04 |
| IL-21m_L28D | 2.14 | 3.9E+03 | 3.6E+01 | 4.1E+01 | 9.8E+04 |
| IL-21m_Y45G | 2.43 | 1.4E+04 | 8.4E+01 | 4.0E+01 | 9.8E+04 |
| IL-21m_I141G | 2.23 | 3.5E+04 | 3.4E+02 | 6.7E+01 | 9.7E+04 |
| IL-21m_M140F | 2.29 | 6.2E+03 | 6.7E+01 | 2.9E+01 | 9.6E+04 |
| IL-21m_L29K | 2.52 | 2.0E+03 | 3.5E+01 | 1.8E+01 | 9.6E+04 |
| IL-21m_D26E | 2.04 | 3.2E+03 | 2.7E+01 | 1.6E+01 | 9.5E+04 |
| IL-21m_R27T | 2.14 | 2.1E+04 | 2.9E+01 | 2.2E+01 | 9.5E+04 |
| IL-21m_L28S | 2.23 | 7.2E+02 | 2.2E+01 | 1.4E+01 | 9.5E+04 |
| IL-21m_P126F | 2.22 | 2.0E+04 | 2.5E+02 | 8.0E+01 | 9.4E+04 |
| IL-21m_L92E | 2.25 | 4.9E+04 | 2.2E+03 | 5.7E+02 | 9.4E+04 |
| IL-21m_I141N | 2.17 | 2.4E+04 | 3.3E+02 | 4.8E+01 | 9.4E+04 |
| IL-21m_V60R | 2.06 | 3.3E+04 | 1.7E+03 | 1.3E+02 | 9.2E+04 |
| IL-21m_V60H | 2.11 | 3.9E+04 | 3.3E+02 | 6.3E+01 | 9.2E+04 |
| IL-21m_Q73V | 2.19 | 1.0E+03 | 2.5E+01 | 1.8E+01 | 9.1E+04 |
| IL-21m_A68G | 2.56 | 1.5E+04 | 6.2E+01 | 2.6E+01 | 9.1E+04 |
| IL-21m_I141P | 2.41 | 3.3E+04 | 2.7E+03 | 8.1E+02 | 9.1E+04 |
| IL-21m_I141Q | 2.02 | 2.4E+03 | 3.4E+01 | 1.8E+01 | 9.1E+04 |
| IL-21m_I89N | 2.3 | 6.1E+04 | 2.4E+03 | 1.7E+02 | 9.0E+04 |
| IL-21m_L28N | 2.26 | 9.9E+02 | 2.7E+01 | 1.7E+01 | 8.9E+04 |
| IL-21m_L96W | 2.16 | 5.9E+04 | 9.8E+02 | 1.8E+02 | 8.9E+04 |
| IL-21m_Q95H | 2.21 | 5.1E+03 | 4.5E+01 | 2.2E+01 | 8.8E+04 |
| IL-21m_Y45T | 2.32 | 3.9E+03 | 4.8E+01 | 3.1E+01 | 8.8E+04 |
| IL-21m_E40K | 2.09 | 8.0E+02 | 2.0E+01 | 7.0E+00 | 8.8E+04 |
| IL-21m_L32S | 2.78 | 7.2E+04 | 1.9E+04 | NA | 8.8E+04 |
| IL-21m_LA2D | 2.29 | 7.7E+04 | 1.8E+04 | NA | 8.8E+04 |
| IL-21m_A75F | 2.03 | 3.9E+03 | 5.9E+01 | 2.7E+01 | 8.7E+04 |
| IL-21m_R27D | 2 | 1.2E+05 | 1.5E+03 | 1.4E+02 | 8.7E+04 |
| IL-21m_L49V | 2.19 | 2.2E+03 | 3.8E+01 | 1.7E+01 | 8.6E+04 |
| IL-21m_M140K | 2.34 | 2.1E+04 | 1.2E+02 | 2.3E+01 | 8.6E+04 |
| IL-21m_F129M | 2.26 | 7.2E+02 | 3.3E+01 | 1.5E+01 | 8.5E+04 |
| IL-21m_L130E | 2.33 | 7.8E+04 | 7.7E+03 | 2.3E+03 | 8.5E+04 |
| IL-21m_L96Y | 2.09 | 9.1E+02 | 3.0E+01 | 1.6E+01 | 8.4E+04 |
| IL-21m_L136A | 2.22 | 4.1E+03 | 6.5E+01 | 2.7E+01 | 8.4E+04 |

TABLE 3-continued

Mouse IL-21 Variants Comprising Single Amino Acid Substitutions

| Variant | Average expression bin | Affinity, pH 5 (nM) | Affinity, pH 6 (nM) | Affinity, pH 7 (nM) | Affinity, unbuffered (nM) |
|---|---|---|---|---|---|
| IL-21m_R132P | 2.16 | 6.1E+04 | 7.0E+03 | 8.5E+02 | 8.4E+04 |
| IL-21m_P126G | 2.19 | 1.1E+04 | 1.7E+02 | 6.1E+01 | 8.4E+04 |
| IL-21m_D119K | 2.15 | 6.1E+02 | 3.1E+01 | 1.1E+01 | 8.3E+04 |
| IL-21m_L28G | 2.34 | 1.4E+03 | 2.6E+01 | 1.9E+01 | 8.2E+04 |
| IL-21m_L96E | 2.37 | 1.0E+05 | 4.5E+04 | NA | 8.1E+04 |
| IL-21m_L77A | 2.05 | 3.5E+04 | 3.5E+03 | 4.5E+02 | 8.1E+04 |
| IL-21m_F72K | 2.36 | 1.2E+05 | 2.3E+04 | NA | 8.1E+04 |
| IL-21m_V60E | 2.3 | 5.2E+03 | 5.4E+01 | 2.3E+01 | 8.1E+04 |
| IL-21m_L130T | 2.08 | 3.5E+04 | 3.0E+03 | 3.1E+02 | 8.0E+04 |
| IL-21m_M140A | 2.1 | 1.9E+04 | 1.4E+02 | 4.5E+01 | 7.9E+04 |
| IL-21m_L77F | 2.02 | 3.3E+03 | 4.4E+01 | 2.0E+01 | 7.8E+04 |
| IL-21m_Y121Q | 2.14 | 3.5E+03 | 2.0E+02 | 6.7E+01 | 7.8E+04 |
| IL-21m_Q73I | 2.17 | 1.4E+03 | 3.5E+01 | 1.9E+01 | 7.8E+04 |
| IL-21m_I89Q | 2.01 | 8.2E+04 | 1.7E+03 | 1.6E+02 | 7.7E+04 |
| IL-21m_Q73S | 2.29 | 2.7E+03 | 2.5E+01 | 1.3E+01 | 7.7E+04 |
| IL-21m_E128K | 2.64 | 8.8E+02 | 3.3E+01 | 1.4E+01 | 7.6E+04 |
| IL-21m_Y121N | 2.45 | 3.5E+03 | 4.7E+01 | 2.8E+01 | 7.5E+04 |
| IL-21m_I141K | 2.34 | 1.9E+03 | 4.0E+01 | 1.0E+01 | 7.5E+04 |
| IL-21m_L136Y | 2.27 | 1.4E+03 | 3.3E+01 | 1.3E+01 | 7.4E+04 |
| IL-21m_F72T | 2.13 | 3.1E+04 | 1.4E+03 | 2.3E+02 | 7.4E+04 |
| IL-21m_V93E | 2.23 | 4.0E+03 | 1.1E+02 | 4.2E+01 | 7.4E+04 |
| IL-21m_P116H | 2.12 | 1.9E+03 | 3.9E+01 | 1.6E+01 | 7.4E+04 |
| IL-21m_Q41S | 2.17 | 9.5E+02 | 1.5E+01 | 1.2E+01 | 7.4E+04 |
| IL-21m_P25N | 2.58 | 7.6E+02 | 1.7E+01 | 1.1E+01 | 7.3E+04 |
| IL-21m_L145P | 2.17 | 1.2E+03 | 2.4E+01 | 1.3E+01 | 7.3E+04 |
| IL-21m_L35A | 2.45 | 6.7E+03 | 3.6E+01 | 2.3E+01 | 7.3E+04 |
| IL-21m_I30K | 2.36 | 1.7E+05 | 2.9E+02 | 3.5E+01 | 7.2E+04 |
| IL-21m_R98M | 2.02 | 5.8E+01 | 1.0E+01 | 1.8E+01 | 7.2E+04 |
| IL-21m_N85M | 2.2 | 4.8E+03 | 9.0E+01 | 3.7E+01 | 7.1E+04 |
| IL-21m_E65K | 2.02 | 3.9E+02 | 2.8E+01 | 9.0E+00 | 7.1E+04 |
| IL-21m_I89A | 2.55 | 3.6E+03 | 4.7E+01 | 1.6E+01 | 7.1E+04 |
| IL-21m_H34A | 2.02 | 2.4E+02 | 2.7E+01 | 3.2E+01 | 7.1E+04 |
| IL-21m_L133I | 2.2 | 2.0E+03 | 3.0E+01 | 2.2E+01 | 7.0E+04 |
| IL-21m_L29H | 2.37 | 8.9E+02 | 1.9E+01 | 9.0E+00 | 7.0E+04 |
| IL-21m_D91K | 2.07 | 3.5E+02 | 1.9E+01 | 6.0E+00 | 6.9E+04 |
| IL-21m_T125W | 2.35 | 4.6E+02 | 2.4E+01 | 1.5E+01 | 6.8E+04 |
| IL-21m_M140I | 2.19 | 1.1E+03 | 2.0E+01 | 2.3E+01 | 6.7E+04 |
| IL-21m_L137M | 2.25 | 4.5E+02 | 2.5E+01 | 1.3E+01 | 6.7E+04 |
| IL-21m_Q73A | 2.14 | 1.9E+03 | 2.3E+01 | 1.3E+01 | 6.6E+04 |
| IL-21m_L32I | 2.17 | 6.3E+02 | 2.5E+01 | 1.4E+01 | 6.6E+04 |
| IL-21m_D26S | 2.23 | 1.4E+03 | 2.1E+01 | 1.0E+01 | 6.5E+04 |
| IL-21m_L54K | 2.34 | 3.5E+02 | 2.3E+01 | 1.3E+01 | 6.5E+04 |
| IL-21m_V60A | 2.23 | 5.7E+02 | 2.6E+01 | 1.2E+01 | 6.5E+04 |
| IL-21m_L96Q | 2.18 | 9.8E+04 | 7.3E+04 | 7.0E+03 | 6.4E+04 |
| IL-21m_A68Q | 2.19 | 3.1E+03 | 5.1E+01 | 3.9E+01 | 6.4E+04 |
| IL-21m_R98L | 2.18 | 8.2E+01 | 1.4E+01 | 2.2E+01 | 6.4E+04 |
| IL-21m_D119H | 2.2 | 7.3E+02 | 2.1E+01 | 7.0E+00 | 6.4E+04 |
| IL-21m_Q73T | 2.35 | 3.5E+02 | 1.8E+01 | 1.1E+01 | 6.3E+04 |
| IL-21m_H34N | 2.12 | 1.9E+02 | 2.0E+01 | 2.1E+01 | 6.3E+04 |
| IL-21m_E131W | 2 | 3.2E+02 | 2.2E+01 | 1.0E+01 | 6.3E+04 |
| IL-21m_Y45E | 2.4 | 6.9E+02 | 2.6E+01 | 1.5E+01 | 6.2E+04 |
| IL-21m_K123I | 2.18 | 4.1E+03 | 4.6E+01 | 3.1E+01 | 6.2E+04 |
| IL-21m_I141F | 2.25 | 8.0E+02 | 2.1E+01 | 1.2E+01 | 6.2E+04 |
| IL-21m_D119V | 2.13 | 3.9E+02 | 2.3E+01 | 1.2E+01 | 6.2E+04 |
| IL-21m_L133V | 2.39 | 1.1E+03 | 2.9E+01 | 2.0E+01 | 6.2E+04 |
| IL-21m_E128H | 2.32 | 2.5E+03 | 6.4E+01 | 1.7E+01 | 6.1E+04 |
| IL-21m_E128T | 2.37 | 1.9E+03 | 3.9E+01 | 2.7E+01 | 6.1E+04 |
| IL-21m_F72I | 2.22 | 2.6E+03 | 3.8E+01 | 1.6E+01 | 6.1E+04 |
| IL-21m_E122F | 2.12 | 9.0E+02 | 3.3E+01 | 2.6E+01 | 6.1E+04 |
| IL-21m_A68S | 2.28 | 3.1E+03 | 5.2E+01 | 2.9E+01 | 6.1E+04 |
| IL-21m_L28P | 2.53 | 7.9E+02 | 3.2E+01 | 2.5E+01 | 6.0E+04 |
| IL-21m_F129L | 2.3 | 3.0E+03 | 4.1E+01 | 2.7E+01 | 6.0E+04 |
| IL-21m_D119M | 2.08 | 2.6E+02 | 2.0E+01 | 9.0E+00 | 5.8E+04 |
| IL-21m_I141W | 2.44 | 4.9E+02 | 1.9E+01 | 1.2E+01 | 5.8E+04 |
| IL-21m_Q73N | 2.41 | 1.1E+04 | 7.8E+01 | 2.8E+01 | 5.8E+04 |
| IL-21m_R97L | 2.18 | 8.0E+03 | 9.5E+01 | 3.8E+01 | 5.8E+04 |
| IL-21m_R97F | 2.37 | 8.0E+03 | 5.5E+01 | 2.8E+01 | 5.7E+04 |
| IL-21m_Q73K | 2.3 | 1.5E+04 | 2.6E+02 | 3.9E+01 | 5.7E+04 |
| IL-21m_L136Q | 2.32 | 4.1E+02 | 2.2E+01 | 9.0E+00 | 5.7E+04 |
| IL-21m_A75N | 2.53 | 3.0E+02 | 1.9E+01 | 1.3E+01 | 5.6E+04 |
| IL-21m_L136M | 2.08 | 2.7E+02 | 2.0E+01 | 1.0E+01 | 5.6E+04 |
| IL-21m_Y121R | 2.43 | 3.9E+04 | 7.0E+02 | 8.5E+01 | 5.6E+04 |
| IL-21m_P126K | 2.07 | 3.3E+02 | 1.8E+01 | 1.0E+01 | 5.5E+04 |
| IL-21m_I141H | 2.49 | 4.6E+02 | 1.6E+01 | 8.0E+00 | 5.4E+04 |

TABLE 3-continued

Mouse IL-21 Variants Comprising Single Amino Acid Substitutions

| Variant | Average expression bin | Affinity, pH 5 (nM) | Affinity, pH 6 (nM) | Affinity, pH 7 (nM) | Affinity, unbuffered (nM) |
|---|---|---|---|---|---|
| IL-21m_L100M | 2.22 | 1.3E+03 | 2.4E+01 | 1.8E+01 | 5.4E+04 |
| IL-21m_L28K | 2.57 | 5.7E+02 | 2.0E+01 | 8.0E+00 | 5.3E+04 |
| IL-21m_P25Y | 2.71 | 4.0E+02 | 1.8E+01 | 1.4E+01 | 5.3E+04 |
| IL-21m_E128F | 2.29 | 2.5E+03 | 4.2E+01 | 1.9E+01 | 5.3E+04 |
| IL-21m_F69W | 2.19 | 3.7E+02 | 2.0E+01 | 1.1E+01 | 5.3E+04 |
| IL-21m_I141T | 2.35 | 3.5E+02 | 2.2E+01 | 1.2E+01 | 5.2E+04 |
| IL-21m_D119Q | 2.05 | 2.1E+02 | 1.6E+01 | 7.0E+00 | 5.1E+04 |
| IL-21m_Y121H | 2.58 | 3.1E+02 | 1.7E+01 | 8.0E+00 | 5.1E+04 |
| IL-21m_L35V | 2.36 | 3.2E+02 | 2.0E+01 | 1.1E+01 | 5.1E+04 |
| IL-21m_L29N | 2.43 | 5.7E+02 | 2.1E+01 | 1.5E+01 | 5.1E+04 |
| IL-21m_L28A | 2.28 | 4.1E+02 | 1.9E+01 | 1.1E+01 | 5.0E+04 |
| IL-21m_L136W | 2.51 | 1.3E+03 | 2.5E+01 | 1.2E+01 | 5.0E+04 |
| IL-21m_F129V | 2.23 | 1.0E+03 | 4.0E+01 | 1.8E+01 | 5.0E+04 |
| IL-21m_Y121T | 2.26 | 4.8E+03 | 5.1E+01 | 3.4E+01 | 5.0E+04 |
| IL-21m_LA9Y | 2.17 | 3.6E+02 | 2.1E+01 | 1.1E+01 | 4.9E+04 |
| IL-21m_Y121V | 2.05 | 2.4E+03 | 3.7E+01 | 2.0E+01 | 4.9E+04 |
| IL-21m_A68M | 2.31 | 3.4E+02 | 2.3E+01 | 1.5E+01 | 4.8E+04 |
| IL-21m_Y121M | 2.33 | 7.7E+02 | 3.1E+01 | 1.3E+01 | 4.8E+04 |
| IL-21m_I30V | 2.13 | 4.1E+02 | 1.4E+01 | 9.0E+00 | 4.7E+04 |
| IL-21m_I36K | 2.26 | 2.6E+02 | 1.8E+01 | 1.0E+01 | 4.7E+04 |
| IL-21m_L133G | 2.16 | 1.9E+02 | 1.4E+01 | 8.0E+00 | 4.7E+04 |
| IL-21m_A68V | 2.11 | 5.9E+02 | 3.2E+01 | 1.6E+01 | 4.6E+04 |
| IL-21m_A102H | 2.17 | 1.6E+02 | 1.3E+01 | 5.0E+00 | 4.6E+04 |
| IL-21m_E128Y | 2.29 | 5.1E+02 | 2.3E+01 | 1.1E+01 | 4.6E+04 |
| IL-21m_M140W | 2.36 | 1.4E+02 | 1.3E+01 | 7.0E+00 | 4.6E+04 |
| IL-21m_L35M | 2.09 | 4.3E+02 | 1.4E+01 | 1.0E+01 | 4.5E+04 |
| IL-21m_L96V | 2.36 | 4.9E+02 | 1.8E+01 | 9.0E+00 | 4.5E+04 |
| IL-21m_L130F | 2.11 | 4.3E+02 | 2.0E+01 | 1.3E+01 | 4.5E+04 |
| IL-21m_R132F | 2.2 | 2.4E+03 | 4.1E+01 | 3.4E+01 | 4.4E+04 |
| IL-21m_L29S | 2.58 | 2.7E+02 | 1.4E+01 | 8.0E+00 | 4.3E+04 |
| IL-21m_V93F | 2.16 | 3.8E+02 | 2.6E+01 | 1.4E+01 | 4.3E+04 |
| IL-21m_V93G | 2.33 | 1.0E+03 | 2.2E+01 | 1.9E+01 | 4.2E+04 |
| IL-21m_F72V | 2.47 | 1.7E+03 | 3.9E+01 | 1.8E+01 | 4.2E+04 |
| IL-21m_E128G | 2.32 | 1.5E+03 | 3.8E+01 | 1.6E+01 | 4.2E+04 |
| IL-21m_L130M | 2.19 | 1.7E+03 | 4.0E+01 | 1.6E+01 | 4.2E+04 |
| IL-21m_R99W | 2.41 | 4.4E+03 | 4.3E+01 | 3.5E+01 | 4.1E+04 |
| IL-21m_E40H | 2.01 | 2.3E+02 | 2.0E+01 | 9.0E+00 | 4.1E+04 |
| IL-21m_L54T | 2.06 | 1.2E+03 | 3.4E+01 | 1.7E+01 | 4.1E+04 |
| IL-21m_V39S | 2.41 | 3.3E+02 | 2.2E+01 | 1.2E+01 | 4.1E+04 |
| IL-21m_L92V | 2.16 | 2.4E+03 | 3.8E+01 | 1.3E+01 | 4.0E+04 |
| IL-21m_I90R | 2.06 | 6.9E+01 | 1.1E+01 | 4.0E+00 | 4.0E+04 |
| IL-21m_R124W | 2.26 | 2.0E+03 | 3.2E+01 | 4.2E+01 | 4.0E+04 |
| IL-21m_A75S | 2.14 | 4.3E+02 | 2.6E+01 | 1.6E+01 | 3.9E+04 |
| IL-21m_E46K | 2.32 | 1.4E+02 | 1.3E+01 | 6.0E+00 | 3.9E+04 |
| IL-21m_R132V | 2.19 | 8.0E+02 | 2.5E+01 | 1.4E+01 | 3.9E+04 |
| IL-21m_A67G | 2.05 | 5.1E+02 | 2.8E+01 | 1.4E+01 | 3.9E+04 |
| IL-21m_D48V | 2.48 | 2.2E+02 | 1.6E+01 | 1.0E+01 | 3.9E+04 |
| IL-21m_Q95K | 2.4 | 5.1E+02 | 2.4E+01 | 1.0E+01 | 3.8E+04 |
| IL-21m_D119T | 2.17 | 1.5E+02 | 1.5E+01 | 7.0E+00 | 3.8E+04 |
| IL-21m_Q58P | 2.1 | 3.4E+02 | 1.9E+01 | 1.1E+01 | 3.8E+04 |
| IL-21m_L29D | 2.13 | 3.8E+02 | 1.7E+01 | 1.7E+01 | 3.8E+04 |
| IL-21m_I36H | 2.36 | 2.5E+02 | 1.5E+01 | 7.0E+00 | 3.8E+04 |
| IL-21m_D26N | 2.31 | 2.6E+02 | 1.3E+01 | 6.0E+00 | 3.8E+04 |
| IL-21m_H144P | 2.28 | 1.4E+03 | 3.3E+01 | 1.6E+01 | 3.7E+04 |
| IL-21m_R132Y | 2.14 | 8.6E+02 | 3.2E+01 | 1.7E+01 | 3.6E+04 |
| IL-21m_L92I | 2.22 | 1.0E+03 | 2.9E+01 | 2.0E+01 | 3.6E+04 |
| IL-21m_E128A | 2.06 | 3.6E+02 | 2.2E+01 | 1.2E+01 | 3.6E+04 |
| IL-21m_H144F | 2.32 | 8.2E+02 | 2.5E+01 | 1.4E+01 | 3.6E+04 |
| IL-21m_K123D | 2.1 | 8.4E+02 | 3.3E+01 | 2.1E+01 | 3.5E+04 |
| IL-21m_D48H | 2.05 | 1.3E+02 | 1.2E+01 | 5.0E+00 | 3.5E+04 |
| IL-21m_D119S | 2.06 | 1.8E+02 | 1.6E+01 | 7.0E+00 | 3.5E+04 |
| IL-21m_V93Y | 2.2 | 3.4E+03 | 3.4E+01 | 2.6E+01 | 3.4E+04 |
| IL-21m_I141A | 2.22 | 3.4E+02 | 1.6E+01 | 9.0E+00 | 3.4E+04 |
| IL-21m_I36G | 2.55 | 3.0E+02 | 1.9E+01 | 1.0E+01 | 3.4E+04 |
| IL-21m_L136N | 2.18 | 5.5E+02 | 2.3E+01 | 1.0E+01 | 3.3E+04 |
| IL-21m_P126M | 2.38 | 3.9E+02 | 1.9E+01 | 1.3E+01 | 3.3E+04 |
| IL-21m_Y45K | 2.37 | 3.5E+02 | 1.8E+01 | 1.0E+01 | 3.3E+04 |
| IL-21m_L29Q | 2.39 | 3.2E+02 | 1.7E+01 | 1.0E+01 | 3.2E+04 |
| IL-21m_L136T | 2.16 | 3.4E+02 | 2.5E+01 | 1.3E+01 | 3.2E+04 |
| IL-21m_D50Q | 2.56 | 8.7E+01 | 1.0E+01 | 5.0E+00 | 3.2E+04 |
| IL-21m_H144G | 2.16 | 6.9E+02 | 2.3E+01 | 1.4E+01 | 3.2E+04 |
| IL-21m_P116V | 2.04 | 3.4E+02 | 2.0E+01 | 1.4E+01 | 3.2E+04 |
| IL-21m_L28W | 2.69 | 1.4E+02 | 1.2E+01 | 7.0E+00 | 3.2E+04 |
| IL-21m_D119A | 2.1 | 1.3E+02 | 1.4E+01 | 5.0E+00 | 3.2E+04 |

TABLE 3-continued

Mouse IL-21 Variants Comprising Single Amino Acid Substitutions

| Variant | Average expression bin | Affinity, pH 5 (nM) | Affinity, pH 6 (nM) | Affinity, pH 7 (nM) | Affinity, unbuffered (nM) |
|---|---|---|---|---|---|
| IL-21m_R99Y | 2.12 | 2.0E+03 | 2.7E+01 | 1.6E+01 | 3.2E+04 |
| IL-21m_F88G | 2.51 | 4.5E+02 | 2.1E+01 | 1.1E+01 | 3.1E+04 |
| IL-21m_E131K | 2.22 | 1.4E+02 | 1.6E+01 | 8.0E+00 | 3.1E+04 |
| IL-21m_P126L | 2.34 | 6.2E+02 | 2.6E+01 | 1.5E+01 | 3.1E+04 |
| IL-21m_Y45S | 2.4 | 3.0E+02 | 1.7E+01 | 8.0E+00 | 3.1E+04 |
| IL-21m_L130I | 2.21 | 2.7E+02 | 2.0E+01 | 1.2E+01 | 3.1E+04 |
| IL-21m_L28H | 2.38 | 2.6E+02 | 1.2E+01 | 6.0E+00 | 3.1E+04 |
| IL-21m_F88S | 2.14 | 2.3E+02 | 1.6E+01 | 8.0E+00 | 3.1E+04 |
| IL-21m_Y121E | 2.34 | 1.1E+03 | 2.5E+01 | 2.2E+01 | 3.0E+04 |
| IL-21m_D119N | 2.05 | 1.7E+02 | 1.4E+01 | 6.0E+00 | 3.0E+04 |
| IL-21m_A70F | 2.33 | 1.2E+02 | 1.6E+01 | 1.0E+01 | 2.9E+04 |
| IL-21m_Q95M | 2.41 | 5.0E+02 | 2.8E+01 | 2.0E+01 | 2.9E+04 |
| IL-21m_G105R | 2.06 | 1.1E+02 | 1.1E+01 | 5.0E+00 | 2.9E+04 |
| IL-21m_R132I | 2.21 | 7.0E+02 | 3.1E+01 | 1.8E+01 | 2.8E+04 |
| IL-21m_E40T | 2.13 | 1.7E+02 | 1.5E+01 | 7.0E+00 | 2.8E+04 |
| IL-21m_E131H | 2.22 | 1.4E+02 | 1.4E+01 | 6.0E+00 | 2.8E+04 |
| IL-21m_E131R | 2.25 | 1.1E+02 | 1.3E+01 | 6.0E+00 | 2.7E+04 |
| IL-21m_LA2M | 2 | 3.0E+02 | 1.8E+01 | 1.1E+01 | 2.7E+04 |
| IL-21m_P116N | 2.13 | 5.1E+02 | 2.4E+01 | 1.2E+01 | 2.7E+04 |
| IL-21m_P79G | 2.2 | 2.3E+02 | 1.8E+01 | 9.0E+00 | 2.6E+04 |
| IL-21m_Y45Q | 2.39 | 1.0E+02 | 1.2E+01 | 7.0E+00 | 2.6E+04 |
| IL-21m_L92Y | 2.31 | 3.7E+02 | 2.3E+01 | 2.4E+01 | 2.6E+04 |
| IL-21m_P116G | 2.2 | 3.1E+02 | 2.1E+01 | 1.0E+01 | 2.6E+04 |
| IL-21m_L29M | 2.71 | 1.4E+02 | 1.3E+01 | 7.0E+00 | 2.5E+04 |
| IL-21m_I36R | 2.21 | 1.8E+02 | 1.5E+01 | 1.0E+01 | 2.5E+04 |
| IL-21m_L28Q | 2.07 | 1.7E+02 | 1.8E+01 | 1.2E+01 | 2.5E+04 |
| IL-21m_K123W | 2.05 | 8.5E+02 | 2.7E+01 | 1.6E+01 | 2.5E+04 |
| IL-21m_H144K | 2.11 | 1.3E+02 | 1.4E+01 | 7.0E+00 | 2.5E+04 |
| IL-21m_V60Y | 2.02 | 2.0E+02 | 1.7E+01 | 8.0E+00 | 2.5E+04 |
| IL-21m_L96I | 2.24 | 1.9E+02 | 1.5E+01 | 7.0E+00 | 2.5E+04 |
| IL-21m_P79N | 2.4 | 3.1E+02 | 2.0E+01 | 1.1E+01 | 2.5E+04 |
| IL-21m_L53F | 2.68 | 2.7E+02 | 1.8E+01 | 9.0E+00 | 2.4E+04 |
| IL-21m_E40S | 2.16 | 1.1E+02 | 1.2E+01 | 7.0E+00 | 2.4E+04 |
| IL-21m_A70W | 2.07 | 1.8E+02 | 1.7E+01 | 9.0E+00 | 2.4E+04 |
| IL-21m_L100I | 2.45 | 2.2E+02 | 1.4E+01 | 8.0E+00 | 2.4E+04 |
| IL-21m_I89M | 2.36 | 2.1E+02 | 1.7E+01 | 9.0E+00 | 2.3E+04 |
| IL-21m_Y121S | 2.28 | 3.4E+02 | 2.4E+01 | 1.3E+01 | 2.3E+04 |
| IL-21m_R97Y | 2.04 | 1.9E+03 | 2.4E+01 | 2.1E+01 | 2.3E+04 |
| IL-21m_P79F | 2.12 | 1.4E+02 | 1.3E+01 | 9.0E+00 | 2.3E+04 |
| IL-21m_D119G | 2.26 | 1.2E+02 | 1.4E+01 | 6.0E+00 | 2.3E+04 |
| IL-21m_I38M | 2.12 | 3.2E+02 | 1.5E+01 | 1.1E+01 | 2.3E+04 |
| IL-21m_N85P | 2.1 | 9.8E+02 | 3.2E+01 | 1.8E+01 | 2.2E+04 |
| IL-21m_I141M | 2.06 | 1.9E+02 | 1.4E+01 | 7.0E+00 | 2.2E+04 |
| IL-21m_A94V | 2 | 1.1E+02 | 1.3E+01 | 7.0E+00 | 2.2E+04 |
| IL-21m_G83K | 2.03 | 1.3E+02 | 1.5E+01 | 7.0E+00 | 2.2E+04 |
| IL-21m_W135P | 2.33 | 4.2E+02 | 1.9E+01 | 1.1E+01 | 2.2E+04 |
| IL-21m_P116T | 2.39 | 1.6E+02 | 1.5E+01 | 6.0E+00 | 2.1E+04 |
| IL-21m_V60M | 2.01 | 3.0E+02 | 2.0E+01 | 1.0E+01 | 2.1E+04 |
| IL-21m_V60T | 2.2 | 3.4E+02 | 2.2E+01 | 1.2E+01 | 2.1E+04 |
| IL-21m_S120K | 2.25 | 1.1E+02 | 1.2E+01 | 5.0E+00 | 2.1E+04 |
| IL-21m_P79D | 2.4 | 3.0E+02 | 2.1E+01 | 1.1E+01 | 2.1E+04 |
| IL-21m_E65R | 2.02 | 1.6E+02 | 1.6E+01 | 5.0E+00 | 2.0E+04 |
| IL-21m_S117I | 2.12 | 1.5E+02 | 1.6E+01 | 1.0E+01 | 2.0E+04 |
| IL-21m_L133Y | 2.18 | 1.0E+02 | 1.1E+01 | 6.0E+00 | 2.0E+04 |
| IL-21m_A75L | 2.44 | 4.8E+02 | 2.5E+01 | 1.7E+01 | 1.9E+04 |
| IL-21m_K127W | 2.23 | 1.9E+02 | 1.7E+01 | 9.0E+00 | 1.9E+04 |
| IL-21m_I38A | 2.26 | 1.4E+02 | 1.3E+01 | 7.0E+00 | 1.9E+04 |
| IL-21m_P22R | 2.15 | 7.9E+01 | 1.0E+01 | 6.0E+00 | 1.9E+04 |
| IL-21m_P79W | 2.1 | 2.9E+02 | 1.9E+01 | 9.0E+00 | 1.9E+04 |
| IL-21m_P116S | 2.35 | 1.7E+02 | 1.5E+01 | 9.0E+00 | 1.8E+04 |
| IL-21m_L35I | 2.12 | 1.6E+02 | 1.4E+01 | 9.0E+00 | 1.8E+04 |
| IL-21m_L28R | 2.44 | 7.2E+01 | 1.2E+01 | 5.0E+00 | 1.8E+04 |
| IL-21m_L133A | 2.1 | 1.2E+02 | 1.2E+01 | 7.0E+00 | 1.8E+04 |
| IL-21m_L29V | 2.06 | 1.5E+02 | 1.1E+01 | 6.0E+00 | 1.8E+04 |
| IL-21m_V60P | 2.06 | 2.1E+02 | 1.7E+01 | 9.0E+00 | 1.8E+04 |
| IL-21m_T125I | 2.27 | 1.3E+02 | 1.4E+01 | 8.0E+00 | 1.8E+04 |
| IL-21m_Q41N | 2.14 | 1.2E+02 | 1.2E+01 | 6.0E+00 | 1.8E+04 |
| IL-21m_F72A | 2.27 | 2.8E+02 | 1.8E+01 | 1.0E+01 | 1.7E+04 |
| IL-21m_E122L | 2.01 | 1.6E+02 | 1.5E+01 | 8.0E+00 | 1.7E+04 |
| IL-21m_K43D | 2.6 | 3.8E+02 | 2.3E+01 | 1.4E+01 | 1.7E+04 |
| IL-21m_E122H | 2.37 | 1.3E+02 | 1.1E+01 | 6.0E+00 | 1.7E+04 |
| IL-21m_F129A | 2.18 | 2.1E+02 | 1.7E+01 | 8.0E+00 | 1.6E+04 |
| IL-21m_E131A | 2.15 | 7.3E+01 | 1.0E+01 | 5.0E+00 | 1.6E+04 |
| IL-21m_A56I | 2.05 | 2.2E+02 | 1.7E+01 | 9.0E+00 | 1.6E+04 |

TABLE 3-continued

Mouse IL-21 Variants Comprising Single Amino Acid Substitutions

| Variant | Average expression bin | Affinity, pH 5 (nM) | Affinity, pH 6 (nM) | Affinity, pH 7 (nM) | Affinity, unbuffered (nM) |
|---|---|---|---|---|---|
| IL-21m_P79Q | 2.14 | 2.4E+02 | 2.2E+01 | 1.4E+01 | 1.6E+04 |
| IL-21m_L92F | 2.37 | 3.5E+02 | 1.8E+01 | 1.0E+01 | 1.6E+04 |
| IL-21m_A67P | 2.08 | 1.4E+02 | 1.5E+01 | 9.0E+00 | 1.5E+04 |
| IL-21m_L29T | 2.18 | 1.3E+02 | 1.1E+01 | 7.0E+00 | 1.5E+04 |
| IL-21m_Q95N | 2.42 | 2.1E+02 | 1.6E+01 | 1.1E+01 | 1.5E+04 |
| IL-21m_I36F | 2.07 | 1.2E+02 | 1.2E+01 | 7.0E+00 | 1.5E+04 |
| IL-21m_L53I | 2.14 | 1.2E+02 | 1.1E+01 | 6.0E+00 | 1.5E+04 |
| IL-21m_E131G | 2.39 | 1.4E+02 | 1.3E+01 | 6.0E+00 | 1.5E+04 |
| IL-21m_F69V | 2.35 | 1.4E+02 | 1.3E+01 | 7.0E+00 | 1.4E+04 |
| IL-21m_Q138K | 2.31 | 1.0E+02 | 1.5E+01 | 7.0E+00 | 1.4E+04 |
| IL-21m_I36W | 2.04 | 1.9E+02 | 1.6E+01 | 8.0E+00 | 1.4E+04 |
| IL-21m_S55K | 2.19 | 9.5E+01 | 1.2E+01 | 5.0E+00 | 1.4E+04 |
| IL-21m_L77M | 2.26 | 2.8E+02 | 1.9E+01 | 1.0E+01 | 1.4E+04 |
| IL-21m_I90H | 2.16 | 7.8E+01 | 1.0E+01 | 4.0E+00 | 1.4E+04 |
| IL-21m_D59Q | 2.52 | 1.9E+02 | 1.5E+01 | 8.0E+00 | 1.3E+04 |
| IL-21m_H144W | 2.29 | 4.2E+02 | 2.0E+01 | 1.5E+01 | 1.3E+04 |
| IL-21m_K123T | 2.02 | 2.6E+02 | 2.3E+01 | 1.5E+01 | 1.3E+04 |
| IL-21m_L29A | 2.42 | 1.3E+02 | 1.3E+01 | 7.0E+00 | 1.3E+04 |
| IL-21m_L145G | 2.24 | 9.6E+01 | 1.2E+01 | 6.0E+00 | 1.3E+04 |
| IL-21m_P126A | 2.17 | 2.7E+02 | 1.9E+01 | 1.1E+01 | 1.3E+04 |
| IL-21m_S120G | 2.03 | 1.6E+02 | 1.6E+01 | 8.0E+00 | 1.3E+04 |
| IL-21m_F88D | 2.43 | 1.3E+02 | 1.0E+01 | 8.0E+00 | 1.3E+04 |
| IL-21m_E128L | 2.27 | 1.4E+02 | 1.4E+01 | 7.0E+00 | 1.3E+04 |
| IL-21m_L145D | 2.14 | 2.1E+02 | 1.8E+01 | 9.0E+00 | 1.3E+04 |
| IL-21m_I36N | 2.38 | 1.1E+02 | 1.2E+01 | 7.0E+00 | 1.2E+04 |
| IL-21m_E122M | 2.1 | 1.3E+02 | 1.4E+01 | 7.0E+00 | 1.2E+04 |
| IL-21m_L145W | 2.41 | 1.3E+02 | 1.2E+01 | 6.0E+00 | 1.2E+04 |
| IL-21m_A94H | 2.38 | 5.5E+01 | 9.0E+00 | 3.0E+00 | 1.2E+04 |
| IL-21m_I90K | 2.25 | 6.0E+01 | 9.0E+00 | 3.0E+00 | 1.2E+04 |
| IL-21m_P116L | 2.18 | 1.8E+02 | 1.6E+01 | 1.1E+01 | 1.1E+04 |
| IL-21m_L145R | 2.21 | 1.4E+02 | 1.3E+01 | 7.0E+00 | 1.1E+04 |
| IL-21m_Q138R | 2.42 | 8.7E+01 | 1.1E+01 | 6.0E+00 | 1.1E+04 |
| IL-21m_Y121G | 2.48 | 3.1E+02 | 2.2E+01 | 1.6E+01 | 1.1E+04 |
| IL-21m_E131F | 2.35 | 1.1E+02 | 1.2E+01 | 5.0E+00 | 1.1E+04 |
| IL-21m_A70H | 2.08 | 1.0E+02 | 1.2E+01 | 5.0E+00 | 1.1E+04 |
| IL-21m_E122Q | 2.13 | 6.4E+01 | 1.1E+01 | 4.0E+00 | 1.1E+04 |
| IL-21m_L145F | 2.1 | 1.1E+02 | 1.0E+01 | 6.0E+00 | 1.1E+04 |
| IL-21m_G105K | 2.12 | 1.1E+02 | 1.3E+01 | 5.0E+00 | 1.0E+04 |
| IL-21m_L136I | 2.11 | 1.1E+02 | 1.2E+01 | 7.0E+00 | 1.0E+04 |
| IL-21m_E128Q | 2.25 | 1.4E+02 | 1.5E+01 | 8.0E+00 | 9.8E+03 |
| IL-21m_I141Y | 2.14 | 1.2E+02 | 1.1E+01 | 6.0E+00 | 9.6E+03 |
| IL-21m_L136V | 2.41 | 1.0E+02 | 1.1E+01 | 5.0E+00 | 9.6E+03 |
| IL-21m_L29G | 2.2 | 1.4E+02 | 1.3E+01 | 8.0E+00 | 9.5E+03 |
| IL-21m_P51R | 2.17 | 6.1E+01 | 9.0E+00 | 3.0E+00 | 9.3E+03 |
| IL-21m_Q95A | 2.1 | 9.5E+01 | 1.1E+01 | 6.0E+00 | 9.2E+03 |
| IL-21m_E40G | 2.36 | 9.3E+01 | 1.2E+01 | 7.0E+00 | 9.1E+03 |
| IL-21m_Y45R | 2.27 | 1.1E+02 | 1.2E+01 | 7.0E+00 | 9.0E+03 |
| IL-21m_T125K | 2.24 | 9.9E+01 | 1.2E+01 | 5.0E+00 | 8.6E+03 |
| IL-21m_L29E | 2.03 | 2.0E+02 | 1.5E+01 | 1.0E+01 | 8.5E+03 |
| IL-21m_V60W | 2 | 1.7E+02 | 1.4E+01 | 7.0E+00 | 8.4E+03 |
| IL-21m_E46N | 2.08 | 1.2E+02 | 1.2E+01 | 6.0E+00 | 8.2E+03 |
| IL-21m_F69M | 2.36 | 1.1E+02 | 1.1E+01 | 5.0E+00 | 8.2E+03 |
| IL-21m_Y45A | 2.43 | 1.4E+02 | 1.2E+01 | 7.0E+00 | 8.2E+03 |
| IL-21m_R99L | 2.13 | 3.9E+02 | 1.7E+01 | 8.0E+00 | 7.9E+03 |
| IL-21m_F88A | 2.21 | 1.2E+02 | 1.0E+01 | 5.0E+00 | 7.9E+03 |
| IL-21m_L54A | 2.14 | 1.7E+02 | 1.3E+01 | 7.0E+00 | 7.8E+03 |
| IL-21m_E122G | 2.31 | 7.0E+01 | 1.0E+01 | 5.0E+00 | 7.7E+03 |
| IL-21m_L145S | 2.11 | 1.3E+02 | 1.5E+01 | 7.0E+00 | 7.4E+03 |
| IL-21m_M140L | 2.35 | 1.7E+02 | 1.5E+01 | 8.0E+00 | 7.3E+03 |
| IL-21m_R132T | 2.1 | 2.0E+02 | 1.9E+01 | 1.0E+01 | 7.3E+03 |
| IL-21m_E131S | 2.13 | 7.3E+01 | 1.0E+01 | 5.0E+00 | 7.3E+03 |
| IL-21m_K123H | 2.02 | 1.4E+02 | 1.7E+01 | 9.0E+00 | 7.1E+03 |
| IL-21m_E122N | 2.15 | 1.1E+02 | 1.3E+01 | 6.0E+00 | 7.0E+03 |
| IL-21m_F88Q | 2.2 | 8.5E+01 | 8.0E+00 | 4.0E+00 | 6.9E+03 |
| IL-21m_G106K | 2.36 | 7.6E+01 | 1.0E+01 | 4.0E+00 | 6.6E+03 |
| IL-21m_E122S | 2.08 | 7.5E+01 | 1.1E+01 | 6.0E+00 | 6.6E+03 |
| IL-21m_E131M | 2.23 | 7.7E+01 | 9.0E+00 | 5.0E+00 | 6.5E+03 |
| IL-21m_I36D | 2.6 | 1.6E+02 | 1.5E+01 | 9.0E+00 | 6.3E+03 |
| IL-21m_L145A | 2.3 | 5.7E+01 | 9.0E+00 | 4.0E+00 | 6.3E+03 |
| IL-21m_F88M | 2.28 | 6.5E+01 | 8.0E+00 | 4.0E+00 | 6.3E+03 |
| IL-21m_Q109K | 2.35 | 6.2E+01 | 9.0E+00 | 3.0E+00 | 6.3E+03 |
| IL-21m_L54S | 2.29 | 1.5E+02 | 1.4E+01 | 8.0E+00 | 6.2E+03 |
| IL-21m_G83P | 2.29 | 5.6E+01 | 9.0E+00 | 5.0E+00 | 6.0E+03 |
| IL-21m_P116K | 2.44 | 8.7E+01 | 1.2E+01 | 6.0E+00 | 6.0E+03 |

TABLE 3-continued

| Mouse IL-21 Variants Comprising Single Amino Acid Substitutions | | | | | |
|---|---|---|---|---|---|
| Variant | Average expression bin | Affinity, pH 5 (nM) | Affinity, pH 6 (nM) | Affinity, pH 7 (nM) | Affinity, unbuffered (nM) |
| IL-21m_T87H | 2.26 | 4.4E+01 | 7.0E+00 | 3.0E+00 | 5.9E+03 |
| IL-21m_R132K | 2.02 | 1.2E+02 | 1.3E+01 | 7.0E+00 | 5.9E+03 |
| IL-21m_L145H | 2.29 | 1.3E+02 | 1.2E+01 | 5.0E+00 | 5.6E+03 |
| IL-21m_A67Y | 2.25 | 1.7E+02 | 1.5E+01 | 9.0E+00 | 5.4E+03 |
| IL-21m_Q23R | 2 | 5.9E+01 | 9.0E+00 | 4.0E+00 | 5.4E+03 |
| IL-21m_G105H | 2.06 | 6.8E+01 | 9.0E+00 | 3.0E+00 | 5.4E+03 |
| IL-21m_S120R | 2.26 | 1.0E+02 | 1.2E+01 | 6.0E+00 | 5.3E+03 |
| IL-21m_V39A | 2.34 | 8.0E+01 | 1.0E+01 | 6.0E+00 | 5.3E+03 |
| IL-21m_A75M | 2.28 | 1.5E+02 | 1.3E+01 | 8.0E+00 | 5.2E+03 |
| IL-21m_I112R | 2.24 | 1.2E+02 | 1.4E+01 | 5.0E+00 | 5.2E+03 |
| IL-21m_P116M | 2.4 | 1.1E+02 | 1.2E+01 | 7.0E+00 | 5.2E+03 |
| IL-21m_P126T | 2.09 | 1.4E+02 | 1.3E+01 | 7.0E+00 | 5.2E+03 |
| IL-21m_L28V | 2.03 | 8.3E+01 | 1.3E+01 | 7.0E+00 | 5.1E+03 |
| IL-21m_Q138Y | 2.18 | 6.2E+01 | 9.0E+00 | 5.0E+00 | 5.1E+03 |
| IL-21m_A94G | 2.21 | 9.9E+01 | 1.3E+01 | 9.0E+00 | 5.0E+03 |
| IL-21m_F88E | 2.18 | 7.9E+01 | 9.0E+00 | 6.0E+00 | 5.0E+03 |
| IL-21m_L54H | 2.14 | 7.8E+01 | 9.0E+00 | 4.0E+00 | 4.9E+03 |
| IL-21m_H144D | 2.1 | 9.0E+01 | 1.1E+01 | 1.1E+01 | 4.9E+03 |
| IL-21m_L77V | 2.29 | 8.2E+01 | 1.2E+01 | 6.0E+00 | 4.8E+03 |
| IL-21m_L136H | 2.42 | 6.1E+01 | 8.0E+00 | 4.0E+00 | 4.8E+03 |
| IL-21m_Q95S | 2.25 | 1.9E+02 | 1.7E+01 | 8.0E+00 | 4.7E+03 |
| IL-21m_N84W | 2.03 | 1.4E+02 | 1.4E+01 | 8.0E+00 | 4.7E+03 |
| IL-21m_L145Y | 2.12 | 6.6E+01 | 1.1E+01 | 5.0E+00 | 4.7E+03 |
| IL-21m_L28T | 2.16 | 6.7E+01 | 9.0E+00 | 5.0E+00 | 4.6E+03 |
| IL-21m_K123Y | 2.01 | 1.1E+02 | 1.3E+01 | 7.0E+00 | 4.6E+03 |
| IL-21m_R132H | 2.26 | 1.0E+02 | 1.2E+01 | 7.0E+00 | 4.5E+03 |
| IL-21m_R99P | 2 | 3.2E+02 | 1.1E+01 | 1.2E+01 | 4.4E+03 |
| IL-21m_L32F | 2.3 | 9.5E+01 | 1.2E+01 | 6.0E+00 | 4.3E+03 |
| IL-21m_S117V | 2.17 | 8.5E+01 | 1.2E+01 | 7.0E+00 | 4.3E+03 |
| IL-21m_E122V | 2.26 | 7.1E+01 | 1.1E+01 | 5.0E+00 | 4.2E+03 |
| IL-21m_A75V | 2.28 | 1.4E+02 | 1.3E+01 | 7.0E+00 | 4.2E+03 |
| IL-21m_F88N | 2.32 | 8.8E+01 | 1.0E+01 | 6.0E+00 | 4.2E+03 |
| IL-21m_L145K | 2.4 | 5.7E+01 | 9.0E+00 | 4.0E+00 | 4.2E+03 |
| IL-21m_E52T | 2.01 | 3.5E+01 | 7.0E+00 | 3.0E+00 | 4.1E+03 |
| IL-21m_K123P | 2.18 | 1.6E+02 | 1.5E+01 | 1.7E+01 | 4.1E+03 |
| IL-21m_L136F | 2.25 | 9.6E+01 | 1.1E+01 | 5.0E+00 | 4.0E+03 |
| IL-21m_A67N | 2.04 | 8.0E+01 | 1.1E+01 | 5.0E+00 | 4.0E+03 |
| IL-21m_L53H | 2.1 | 7.0E+01 | 9.0E+00 | 4.0E+00 | 3.9E+03 |
| IL-21m_E40A | 2.15 | 7.2E+01 | 1.1E+01 | 5.0E+00 | 3.8E+03 |
| IL-21m_T125V | 2.31 | 6.5E+01 | 1.1E+01 | 6.0E+00 | 3.8E+03 |
| IL-21m_H144R | 2.13 | 9.1E+01 | 1.2E+01 | 6.0E+00 | 3.8E+03 |
| IL-21m_G83H | 2.16 | 6.1E+01 | 1.0E+01 | 4.0E+00 | 3.8E+03 |
| IL-21m_G106H | 2 | 5.3E+01 | 8.0E+00 | 3.0E+00 | 3.8E+03 |
| IL-21m_E46H | 2.08 | 6.0E+01 | 8.0E+00 | 4.0E+00 | 3.8E+03 |
| IL-21m_R132G | 2.09 | 1.1E+02 | 1.2E+01 | 7.0E+00 | 3.8E+03 |
| IL-21m_R99M | 2.03 | 3.7E+02 | 1.6E+01 | 1.4E+01 | 3.8E+03 |
| IL-21m_S80T | 2.26 | 1.1E+02 | 1.1E+01 | 6.0E+00 | 3.7E+03 |
| IL-21m_P116R | 2.21 | 9.6E+01 | 1.1E+01 | 5.0E+00 | 3.7E+03 |
| IL-21m_G83Y | 2.03 | 9.6E+01 | 1.1E+01 | 7.0E+00 | 3.6E+03 |
| IL-21m_S80H | 2.02 | 5.5E+01 | 9.0E+00 | 4.0E+00 | 3.6E+03 |
| IL-21m_F88W | 2.16 | 8.0E+01 | 1.1E+01 | 6.0E+00 | 3.6E+03 |
| IL-21m_R99H | 2.19 | 8.5E+01 | 1.0E+01 | 7.0E+00 | 3.5E+03 |
| IL-21m_E131V | 2.13 | 6.4E+01 | 1.0E+01 | 5.0E+00 | 3.5E+03 |
| IL-21m_A113H | 2.23 | 7.4E+01 | 1.0E+01 | 4.0E+00 | 3.5E+03 |
| IL-21m_E122A | 2.13 | 5.5E+01 | 9.0E+00 | 4.0E+00 | 3.5E+03 |
| IL-21m_Q109H | 2.17 | 7.9E+01 | 1.1E+01 | 4.0E+00 | 3.4E+03 |
| IL-21m_I141L | 2.16 | 7.1E+01 | 9.0E+00 | 5.0E+00 | 3.4E+03 |
| IL-21m_Q138F | 2.09 | 5.9E+01 | 1.0E+01 | 5.0E+00 | 3.4E+03 |
| IL-21m_P79M | 2.16 | 7.1E+01 | 1.0E+01 | 5.0E+00 | 3.4E+03 |
| IL-21m_A70G | 2.28 | 8.0E+01 | 1.1E+01 | 6.0E+00 | 3.3E+03 |
| IL-21m_E122I | 2.47 | 6.8E+01 | 1.1E+01 | 5.0E+00 | 3.3E+03 |
| IL-21m_K123V | 2.17 | 1.8E+02 | 1.6E+01 | 9.0E+00 | 3.3E+03 |
| IL-21m_H111K | 2.15 | 6.4E+01 | 1.2E+01 | 6.0E+00 | 3.3E+03 |
| IL-21m_G83W | 2.23 | 8.1E+01 | 1.1E+01 | 6.0E+00 | 3.3E+03 |
| IL-21m_I36Y | 2.02 | 8.6E+01 | 1.0E+01 | 6.0E+00 | 3.2E+03 |
| IL-21m_N84Q | 2.02 | 4.1E+01 | 8.0E+00 | 3.0E+00 | 3.2E+03 |
| IL-21m_I36S | 2.58 | 7.2E+01 | 9.0E+00 | 5.0E+00 | 3.2E+03 |
| IL-21m_E46G | 2 | 1.0E+02 | 1.2E+01 | 7.0E+00 | 3.2E+03 |
| IL-21m_E122T | 2.03 | 6.7E+01 | 1.1E+01 | 5.0E+00 | 3.2E+03 |
| IL-21m_R124H | 2.05 | 7.5E+01 | 1.1E+01 | 6.0E+00 | 3.1E+03 |
| IL-21m_N81W | 2.04 | 6.9E+01 | 1.0E+01 | 6.0E+00 | 3.1E+03 |
| IL-21m_A70K | 2.21 | 5.1E+01 | 1.0E+01 | 3.0E+00 | 3.1E+03 |
| IL-21m_T125R | 2.29 | 4.1E+01 | 9.0E+00 | 4.0E+00 | 3.1E+03 |
| IL-21m_S117L | 2.07 | 7.4E+01 | 1.0E+01 | 5.0E+00 | 3.1E+03 |

TABLE 3-continued

Mouse IL-21 Variants Comprising Single Amino Acid Substitutions

| Variant | Average expression bin | Affinity, pH 5 (nM) | Affinity, pH 6 (nM) | Affinity, pH 7 (nM) | Affinity, unbuffered (nM) |
|---|---|---|---|---|---|
| IL-21m_L29Y | 2.11 | 7.1E+01 | 9.0E+00 | 5.0E+00 | 3.1E+03 |
| IL-21m_I141E | 2.22 | 1.0E+02 | 1.2E+01 | 6.0E+00 | 3.0E+03 |
| IL-21m_N84Y | 2.06 | 7.0E+01 | 9.0E+00 | 5.0E+00 | 3.0E+03 |
| IL-21m_R132E | 2.05 | 1.4E+02 | 1.5E+01 | 8.0E+00 | 3.0E+03 |
| IL-21m_Q143K | 2.35 | 6.3E+01 | 9.0E+00 | 4.0E+00 | 3.0E+03 |
| IL-21m_R132D | 2.13 | 1.3E+02 | 1.6E+01 | 9.0E+00 | 3.0E+03 |
| IL-21m_K86V | 2.24 | 7.3E+01 | 1.1E+01 | 6.0E+00 | 2.9E+03 |
| IL-21m_R99G | 2.29 | 4.5E+02 | 1.2E+01 | 1.0E+01 | 2.8E+03 |
| IL-21m_K110R | 2.02 | 9.2E+01 | 1.2E+01 | 5.0E+00 | 2.8E+03 |
| IL-21m_R97V | 2.15 | 1.1E+03 | 2.6E+01 | 1.7E+01 | 2.8E+03 |
| IL-21m_V93T | 2.32 | 6.9E+01 | 1.0E+01 | 4.0E+00 | 2.8E+03 |
| IL-21m_I36A | 2.55 | 5.9E+01 | 8.0E+00 | 4.0E+00 | 2.8E+03 |
| IL-21m_G62K | 2.52 | 6.1E+01 | 1.0E+01 | 4.0E+00 | 2.8E+03 |
| IL-21m_S55G | 2.07 | 8.5E+01 | 1.1E+01 | 6.0E+00 | 2.8E+03 |
| IL-21m_S80D | 2.02 | 1.1E+02 | 1.2E+01 | 7.0E+00 | 2.7E+03 |
| IL-21m_Y121A | 2.21 | 9.8E+01 | 1.0E+01 | 6.0E+00 | 2.7E+03 |
| IL-21m_L96M | 2.14 | 8.4E+01 | 1.1E+01 | 5.0E+00 | 2.7E+03 |
| IL-21m_Q138S | 2.33 | 7.1E+01 | 9.0E+00 | 5.0E+00 | 2.7E+03 |
| IL-21m_L137I | 2.2 | 5.3E+01 | 9.0E+00 | 4.0E+00 | 2.6E+03 |
| IL-21m_K123L | 2.23 | 2.1E+02 | 1.5E+01 | 9.0E+00 | 2.6E+03 |
| IL-21m_L133M | 2.14 | 5.5E+01 | 9.0E+00 | 5.0E+00 | 2.6E+03 |
| IL-21m_P79T | 2.03 | 7.5E+01 | 1.1E+01 | 6.0E+00 | 2.6E+03 |
| IL-21m_S120A | 2.06 | 4.7E+01 | 9.0E+00 | 4.0E+00 | 2.6E+03 |
| IL-21m_S117N | 2.16 | 8.0E+01 | 1.4E+01 | 7.0E+00 | 2.6E+03 |
| IL-21m_S80E | 2.17 | 9.1E+01 | 1.2E+01 | 6.0E+00 | 2.6E+03 |
| IL-21m_Y121F | 2.17 | 6.8E+01 | 1.1E+01 | 5.0E+00 | 2.6E+03 |
| IL-21m_E65D | 2.05 | 6.4E+01 | 1.0E+01 | 5.0E+00 | 2.5E+03 |
| IL-21m_Y45N | 2.51 | 6.8E+01 | 1.0E+01 | 6.0E+00 | 2.5E+03 |
| IL-21m_F72Y | 2.27 | 5.7E+01 | 1.0E+01 | 5.0E+00 | 2.5E+03 |
| IL-21m_H144N | 2.23 | 8.6E+01 | 1.2E+01 | 6.0E+00 | 2.5E+03 |
| IL-21m_T125Y | 2.04 | 5.1E+01 | 9.0E+00 | 4.0E+00 | 2.5E+03 |
| IL-21m_D59S | 2.09 | 6.1E+01 | 1.0E+01 | 5.0E+00 | 2.5E+03 |
| IL-21m_E128D | 2.21 | 6.5E+01 | 9.0E+00 | 5.0E+00 | 2.5E+03 |
| IL-21m_L145Q | 2.21 | 6.0E+01 | 9.0E+00 | 4.0E+00 | 2.5E+03 |
| IL-21m_Q143W | 2.53 | 1.3E+02 | 1.5E+01 | 6.0E+00 | 2.4E+03 |
| IL-21m_A75E | 2.1 | 1.5E+02 | 1.4E+01 | 9.0E+00 | 2.2E+03 |
| IL-21m_Q143F | 2.28 | 1.1E+02 | 1.1E+01 | 6.0E+00 | 2.2E+03 |
| IL-21m_P79E | 2.44 | 1.4E+02 | 1.3E+01 | 6.0E+00 | 2.0E+03 |
| IL-21m_H144Y | 2.09 | 1.1E+02 | 1.1E+01 | 7.0E+00 | 1.9E+03 |
| IL-21m_L54E | 2.32 | 1.6E+02 | 1.3E+01 | 8.0E+00 | 1.6E+03 |
| IL-21m_R99I | 2.25 | 2.3E+02 | 1.8E+01 | 1.2E+01 | 1.4E+03 |
| IL-21m_K123Q | 2.11 | 9.4E+01 | 1.5E+01 | 1.0E+01 | 1.4E+03 |
| IL-21m_K76W | 2.11 | 1.4E+02 | 1.4E+01 | 8.0E+00 | 1.4E+03 |
| IL-21m_R99N | 2.31 | 2.1E+02 | 1.3E+01 | 8.0E+00 | 1.2E+03 |
| IL-21m_S55D | 2.13 | 1.1E+02 | 1.4E+01 | 8.0E+00 | 1.2E+03 |
| IL-21m_R99D | 2.25 | 3.1E+03 | 2.8E+01 | 3.1E+01 | 1.1E+03 |
| IL-21m_K78D | 2.38 | 2.7E+02 | 2.1E+01 | 1.1E+01 | 1.0E+03 |
| IL-21m_R97M | 2.16 | 1.6E+02 | 1.2E+01 | 7.0E+00 | 7.7E+02 |
| IL-21m_R97T | 2.39 | 1.1E+02 | 1.1E+01 | 7.0E+00 | 6.1E+02 |
| IL-21m_R99V | 2.54 | 1.2E+02 | 1.1E+01 | 7.0E+00 | 4.4E+02 |

In some embodiments, the human IL-21 variant includes amino acid substitutions having one or more specific substitutions at one or more, e.g., two or more, three or more, four or more, five or more, six or more, seven or more, eight or more, nine or more, or ten or more, of positions Q32, D33, R34, H35, M36, 137, R38, M39, Q41, L42, I43, D44, I45, V46, D47, Q48, L49, N51, Y52, V53, N54, D55, L56, V57, P58, E59, F60, L61, P62, A63, E65, D66, V67, E68, N70, E72, W73, S74, A75, F76, S77, F79, Q80, K81, A82, Q83, L84, K85, S86, A87, N88, T89, G90, N92, E93, R94, 195, 196, N97, V98, S99, K101, I100, K102, L103, K104, R105, K106, P107, P108, S109, T110, N111, A112, G113, R114, R115, H118, L120, K131, P132, P133, R139, S142, L144, Q145, I148, Q150, H151, and L152 in the wild-type human IL-21 amino acid sequence (SEQ ID NO: 1).

In some embodiments, the IL-21 variant includes amino acid substitutions having one or more, e.g., two or more, or three or more, or four or more, or five or more, or six or more, or seven or more, or eight or more, or nine or more, or ten or more specific substitutions selected from the group consisting of Q32K, Q32I, D33H, D33A, D33N, D33P, D33Q, D33R, D33S, D33T, D33W, D33V, R34A, R34D, R34E, R34F, R34G, R34H, R34K, R34L, R34M, R34N, R34P, R34Q, R34S, R34T, R34V, R34W, R34Y, H35P, H35I, H35F, M36T, M36R, M36P, I37E, I37G, I37K, I37N, I37Q, I37R, I37S, I37V, I37P, I37A, I37W, I37H, I37D, I37T, I37F, R38A, R38P, R38E, R38F, R38K, R38M, R38Q, R38V, R38W, R38N, R38G, R38L, R38S, R38T, R38I, R38D, M39D, M39E, M39G, M39I, M39K, M39P, M39Q, M39R, M39A, Q41K, Q41P, Q41S, Q41E, Q41D, Q41W, Q41R, L42D, L42E, L42G, L42H, L42K, L42N, L42Q, L42R, L42S, L42Y, I43D, I43L, I43M, I43P, I43S, I43Y, I43F, I43R, D44A, D44G, D44N, D44P, D44T, D44W, D44Y, D44F, D44Q, D44S, D44V, D44M, D44L, D44P, D44H, D44R, D44K, I45A, I45D, I45G, I45H, I45N, I45P, I45R, I45S, I45Y, I45T, I45Q, I45F, I45W, I45K, V46D, V46E, V46G, V46K, V46N, V46P, V46Q, V46T, D47P, D47S, D47R, D47K, D47F, D47G, Q48G, Q48K, Q48R, L49D, L49E, L49H, L49K, L49N, L49P, L49R, L49S, L49F, N51E, N51G, N51P, N51V, Y52D, Y52H, Y52K, Y52N, Y52Q, Y52S, Y52T, Y52R, Y52G, V53A, V53E, V53H, V53N, V53P, V53Q, V53S, V53T, V53M, N54H, N54K, N54P, D55K, D55R, D55Y, D55M, L56E, L56F, L56M, L56N, L56S, L56T, L56V, L56D, V57H, V57L, V57M, V57P, V57R, V57T, V57Y, P58M, P58K, E59R, E59S, E59V, E59Y, F60H, F60I, F60R, L61H, L61I, L61K, P62H, P62S, P62T, P62V, P62L, A63T, E65R, D66M, D66R, D66K, V67L, V67K, V67G, E68K, E68R, E68G, N70A, N70H, N70G, E72H, E72I, E72L, E72S, E72T, E72R, E72W, W73A, W73G, W73K, W73L, W73N, W73P, W73Q, W73S, W73T, W73V, W73Y, S74A, S74H, S74N, S74R, S74K, A75N, A75Y, A75V, F76D, F76E, F76H, F76M, F76P, F76Q, F76R, F76T, F76S, F76L, F76V, F76I, F76K, S77K, S77M, S77R, S77W, F79D, F79E, F79K, F79P, F79R, F79T, F79Y, F79I, F79A, F79L, F79V, Q80A, Q80D, Q80L, Q80M, Q80V, Q80I, Q80E, Q80N, Q80H, Q80W, Q80F, Q80K, Q80R, Q80G, Q80Y, K81D, K81H, A82V, A82W, A82M, A82K, A82L, A82I, A82H, A82T, A82Y, A82V, Q83L, Q83W, Q83F, Q83K, Q83H, Q83V, L84P, L84F, L84T, K85S, K85P, S86I, S86M, S86L, S86R, A87N, A87P, N88K, N88R, T89L, T89F, G90Y, G90Q, G90I, G90K, N92G, N92Y, N92W, N92P, E93G, E93T, E93R, E93F, E93P, E93K, E93S, E93V, E93I, E93Y, R94S, R94T, I95H, I95K, I95P, I95T, I95R, I95G, I96A, I96D, I96G, I96P, I96S, I96T, I96V, I96F, I96Y, I96E, I96Q, I96M, I96H, 196N, 196R, 196K, N97G, N97P, N97H, N97W, N97K, N97R, V98H, V98K, V98R, V98E, V98A, V98G, V98Y, V98N, V98S, V98M, V98T, V98P, V98F, S99H, S99R, S99P, S99K, S99G, I100E, I100R, I100S, I100D, I100G, I100F, I100Y, I100Q, I100H, I100A, I100R, K101E, K101D, K102P, K102G, K102L, K102V, K102E, K102I, K102T, K102D, L103E, L103A, L103S, L103T, L103F, L103I, L103W, L103Y, L103V, L103Q, L103H, L103N, K104G, K104P, R105A, R105D, R105K, R105Q, R105S, R105W, R105Y, R105L, R105H, R105M, R105F, R105N, R105I, R105V, R105T, R105E, R105G, R105P, K106E, K106N, K106P, K106S, K106T, K106G, K106H, K106D, P107D, P107Y, P107V, P107H, P107V, P107K, P107R, P108D, P108E, P108G, P108I, P108L, P108Q, P108T, P108A, P108H, P108K, P108Y, P108M, P108N, P108W, P108R, S109K, S109M, S109R, T110D, T110S, T110H, T110N, N111R, N111K, A112P, A112R, A112K, G113R, G113H, R114F, R114Q, R115I, R115P, R115Q, R115D, H118I, H118K, H118R, L120H, L120K, L120M, L120V, L120Y, L120S, K131M, K131V, P132A, P133I, R139S, S142D, S142H, S142I, L144M, Q145H, I148S, Q150D, Q150R, Q150S, H151E, and L152H in the wild-type human IL-21 amino acid sequence (SEQ ID NO: 1).

In some embodiments, the human IL-21 variant includes amino acid substitutions having one or more specific substitutions at one or more, e.g., two or more, three or more, four or more, five or more, six or more, seven or more, eight or more, nine or more, of positions H35, N91, K101, N111, R114, R115, H118, R119, T121 in the wild-type human IL-21 amino acid sequence (SEQ ID NO: 1).

In some embodiments, the IL-21 variant includes amino acid substitutions having one or more, e.g., two or more, or three or more, or four or more, or five or more, or six or more, or seven or more, or eight or more, or nine or more specific substitutions selected from the group consisting of H35F, N91E, K101E, N111E, R114G, R115G, H118D, R119T, and T121E in the wild-type human IL-21 amino acid sequence (SEQ ID NO: 1).

In some embodiments, the IL-21 variant includes the amino acid substitutions H35F, N91E, K101E, N111E, R114G, R115G, H118D, R119T, and T121E in the wild-type human IL-21 amino acid sequence (SEQ ID NO: 1). In some embodiments, the IL-21 variant includes the amino acid substitutions H35F, N91E, and K101E in the wild-type human IL-21 amino acid sequence (SEQ ID NO: 1). In some embodiments, the IL-21 variant includes the amino acid substitutions N111E, R114G, R115G, H118D, R119T, and T121E in the wild-type human IL-21 amino acid sequence (SEQ ID NO: 1). In some embodiments, the IL-21 variant includes the amino acid substitutions N111E, R115G, H118D, and T121E in the wild-type human IL-21 amino acid sequence (SEQ ID NO: 1). In some embodiments, the IL-21 variant includes the amino acid substitutions H35F, R114G, R115G, H118D, R119T, and T121E in the wild-type human IL-21 amino acid sequence (SEQ ID NO: 1).

In some embodiments, the human IL-21 variant includes amino acid substitutions having one or more specific substitutions at one or more, e.g., two or more, three or more, four or more, five or more, six or more, seven or more, eight or more, nine or more, ten or more, 11 or more, 12 or more, 13 of positions H35, 145, N70, K81, V98, P107, T110, A112, R114, R115, H118, R119, T121 in the wild-type human IL-21 amino acid sequence (SEQ ID NO: 1).

In some embodiments, the IL-21 variant includes amino acid substitutions having one or more, e.g., two or more, or three or more, or four or more, or five or more, or six or more, or seven or more, or eight or more, or nine or more, ten or more, 11 or more, 12 or more, 13 or more, 14 or more, 15 or more, or 16 specific substitutions selected from the group consisting of H35F, H35I, I45T, N70G, K81D, V98E, P107V, T110D, A112P, R114Q, R114G, R115D, R115G, H118D, R119T, and T121E in the wild-type human IL-21 amino acid sequence (SEQ ID NO: 1).

In some embodiments, the human IL-21 variant has a binding affinity to the human IL-21R that is decreased by 1.5-fold, 2-fold, 3-fold, 5-fold, 10-fold, 50-fold, 100-fold, 500-fold, 1000-fold, 2000-fold, or 3000-fold, or more relative to the binding affinity between the wild-type human IL-21 polypeptide and the human IL-21R. In some embodiments, the mouse IL-21 variant has a binding affinity to the mouse IL-21R that is decreased by 1.5-fold, 2-fold, 3-fold, 5-fold, 10-fold, 50-fold, 100-fold, 500-fold, 1000-fold, 2000-fold, or 3000-fold or more relative to the binding affinity between the wild-type mouse IL-21 polypeptide and the mouse IL-21R.

IL-21 Fusion Proteins and Methods of Making

This disclosure provides isolated IL-21 fusion proteins (e.g., antibody-IL-21 fusion proteins) that have decreased or no binding to the IL-21R. Such IL-21 fusion proteins can deliver cytokines to a desired cell type while minimizing peripheral exposure and thus reducing overall potential adverse effects, e.g., adverse systemic effects.

The isolated fusion proteins include: an antibody comprising an Fc domain; and a human IL-21 variant, wherein the IL-21 variant is covalently linked to the Fc domain of the antibody.

In some embodiments, one or more polypeptides (e.g., heterologous or homologous sequence) can be inserted between the antibody and the IL-21 variant of the IL-21 fusion proteins as described herein. In some embodiments, the polypeptide can be inserted or conjugated at the amino terminus, at the carboxyl terminus, or both the amino and carboxyl termini of the antibody or domain thereof. In some embodiments, the polypeptide includes a polypeptide linker conjugating the antibody and the IL-21 variant. In some embodiments, the polypeptide comprises one or more linker(s) and tag(s). Examples of a polypeptide tag include, but not are not limited to, a FLAG tag, a 6His tag (SEQ ID NO:3118), an 8His tag (SEQ ID NO: 3119), or an AVI tag.

The antibodies useful in the IL-21 fusion proteins of the present invention can encompass monoclonal antibodies, polyclonal antibodies, antibody fragments (e.g., Fab, Fab', F(ab')2, Fv, Fe, etc.), chimeric antibodies, bispecific antibodies, heteroconjugate antibodies, single chain (ScFv), mutants thereof, fusion proteins comprising an antibody portion (e.g., a domain antibody), humanized antibodies, and any other modified configuration of the immunoglobulin molecule that comprises an antigen recognition site of the required specificity, including glycosylation variants of antibodies, amino acid sequence variants of antibodies, and covalently modified antibodies. The antibodies may be murine, rat, human, or any other origin (including chimeric or humanized antibodies.

In some embodiments, an antibody constant region can be modified to avoid interaction with Fc gamma receptors and/or the complement system. The techniques for preparation of such antibodies are described in WO 99/58572. For example, the constant region may be engineered to more resemble human constant regions to avoid immune response if the antibody is used in clinical trials and treatments in humans. See, e.g., U.S. Pat. Nos. 5,997,867 and 5,866,692.

In still other embodiments, the constant region is a glycosylated for N-linked glycosylation, e.g., the antibodies are engineered to bypass glycosylation. In some embodiments, the constant region is a glycosylated for N-linked glycosylation by mutating the oligosaccharide attachment residue and/or flanking residues that are part of the N-glycosylation recognition sequence in the constant region. For example, N-glycosylation site N297 may be mutated to, e.g., A, Q, K, or H. See, Tao et al., J. Immunology 143: 2595-2601, 1989; and Jefferis et al., Immunological Reviews 163:59-76, 1998. In some embodiments, the constant region is enzymatically aglycosylated for N-linked glycosylation (such as removing carbohydrate by the enzyme PNGase), or by expression in a glycosylation deficient host cell.

Other antibody modifications include antibodies that have been modified as described in PCT Publication No. WO 99/58572, which is hereby incorporated by reference in its entirety. These antibodies comprise, in addition to a binding domain directed at the target molecule, an effector domain having an amino acid sequence substantially homologous to all or part of a constant region of a human immunoglobulin heavy chain. These antibodies are capable of binding to the target molecule without triggering significant complement dependent lysis, or cell-mediated destruction of the target. In some embodiments, the effector domain is capable of specifically binding to FcRn and/or FcγRIIb. These are typically based on chimeric domains derived from two or more human immunoglobulin heavy chain CH2 domains. Antibodies modified in this manner are particularly suitable for use in chronic antibody therapy, to avoid inflammatory and other adverse reactions to conventional antibody therapy. In some embodiments, an antibody constant region can be modified to avoid interaction with Fc gamma receptors and/or the complement system. The techniques for preparation of such antibodies are described in WO 99/58572. For example, the constant region may be engineered to more resemble human constant regions to avoid immune response if the antibody is used in clinical trials and treatments in humans. See, e.g., U.S. Pat. Nos. 5,997,867 and 5,866,692, each of which are hereby incorporated by reference in their entirety.

The antibodies used in the IL-21 fusion proteins of the compositions and methods disclosed herein, listed by International Nonproprietary Name, can include, but are not limited to, abagovomab, abatacept, abciximababelacimab, abituzumab, abrezekimab, abrilumab, acapatamab, acasunlimab, acazicolcept, acrixolimab, actoxumab, adalimumab, adebrelimab, adecatumumab, adintrevimab, aducanumab, afasevikumab, afelimomab, aflibercept, alacizumab, alefacept, alemtuzumab, alirocumab, alnuctamab, alomfilimab, alsevalimab, altumomab, amatuximab, amivantamab, amlitelimab, amubarvimab, anatumomab, anbenitamab, andecaliximab, anetumab, anifrolumab, anivovetmab, anrukinzumab, anselamimab, ansuvimab, anumigilimab, apamistamab, apitegromab, apolizumab, aprutumab, arcitumomab, ascrinvacumab, aselizumab, asfotase, astegolimab, asunercept, atacicept, atezolizumab, atibuclimab, atidortoxumab, atinumab, atoltivimab, atorolimumab, avdoralimab, avelumab, avizakimab, axatilimab, azintuxizumab, bafisontamab, balstilimab, baminercept, bamlanivimab, bapineuzumab, bapotulimab, barecetamab, barzolvolimab, basiliximab, batiraxcept, batoclimab, bavituximab, bavunalimab, bebtelovimab, bectumomab, bedinvetmab, befovacimab, begelomab, belantamab, belatacept, belimumab, beludavimab, bemarituzumab, benralizumab, bentracimab, benufutamab, bepranemab, berlimatoxumab, bermekimab, bersanlimab, bertilimumab, besilesomab, betifisolimab, bevacizumab, bexmarilimab, bezlotoxumab, biciromab, bifikafusp, bimagrumab, bimekizumab, bintrafusp, birtamimab, bivatuzumab, bleselumab, blinatumomab, blisibimod, blontuvetmab, blosozumab, bococizumab, botensilimab, brazikumab, brentuximab, briakinumab, briobacept, briquilimab, brodalumab, brolucizumab, brontictuzumab, budigalimab, burfiralimab, burosumab, cabiralizumab, cadonilimab, camidanlumab, camoteskimab, camrelizumab, canakinumab, cantuzumab, caplacizumab, capromab, carlumab, carotuximab, casirivimab, catumaxomab, cedelizumab, cemiplimab, cendakimab, cergutuzumab, certolizumab, cetrelimab, cetuximab, cevostamab, cibisatamab, cifurtilimab, cilgavimab, cinpanemab, cinrebafusp, cirevetmab, citatuzumab, cixutumumab, clazakizumab, clenoliximab, clervonafusp, clesrovimab, clivatuzumab, cobolimab, codrituzumab, cofetuzumab, coltuximab, conatumumab, conbercept, concizumab, coprelotamab, cosfroviximab, cosibelimab, crefmirlimab, crenezumab, crexavibart, crizanlizumab, crotedumab, crovalimab, cudarolimab, cusatuzumab, dacetuzumab, daclizumab, dafsolimab, dalantercept, dalotuzumab, dalutrafusp, dapirolizumab, daratumumab, datopotamab, davoceticept, daxdilimab, dectrekumab, demcizumab, demupitamab, denintuzumab, denosumab, depatuxizumab, depemokimab, derlotuximab, detumomab, dezamizumab, dilpacimab, dinutuximab, diridavumab, disitamab, divozilimab, docaravimab, domagrozumab, domvanalimab, donanemab, dorlimomab, dostarlimab, dovanvetmab, dresbuxelimab, drozitumab, dulaglutide, duligotuzumab, dupilumab, durvalumab, dusigitumab, duvortuxizumab, ebdarokimab, eblasakimab, ebronucimab, ecleralimab, ecromeximab, eculizumab, edobacomab, edrecolomab, efalizumab, efanesoctocog, efaprinermin, efavaleukin, efbemalenograstim, efdamrofusp, efepoetin, efgartigimod, efgivanermin, efineptakin, efinopegdutide, efizonerimod, eflapegrastim, eflenograstim, eflepedocokin, eflimrufusp, efmarodocokin, efmitermant, efmoroctocog, efocipegtrutide, efpeglenatid, efpegsomatropin, efprezimod, efrilacedase, efruxifermin, eftansomatropin, eftilagimod, eftozanermin, eftrenonacog, efungumab, efzofitimod, eldelumab, elezanumab, elgemtumab, elipovimab, elotuzumab, elranatamab, elsilimomab, eluvixtamab, emactuzumab, emapalumab, emerfetamab, emfizatamab, emibetuzumab, emicizumab, emirodatamab, enapotamab, enavatuzumab, encelimab, enfortumab, enibarcimab, enlimomab, enoblituzumab, enokizumab, enoticumab, ensituximab, ensomafusp, enuzovimab, envafolimab, epcoritamab, epitumomab, epratuzumab, eptinezumab, eramkafusp, erenumab, erfonrilimab, erlizumab, ertumaxomab, etanercept, etaracizumab, etesevimab, etevritamab, etigilimab, etokimab, etrolizumab, evinacumab, evolocumab, evorpacept, exbivirumab, exidavnemab, ezabenlimab, fanolesomab, faralimomab, faricimab, farletuzumab, fasinumab, favezelimab, fazpilodemab, feladilimab, felvizumab, felzartamab, fezakinumab, fianlimab, ficlatuzumab, fidasimtamab, figitumumab, finotonlimab, firivumab, fiztasovimab, flanvotumab, fletikumab, flotetuzumab, fontolizumab, foralumab, foravirumab, fremanezumab, fresolimumab, frexalimab, frovocimab, frunevetmab, fulranumab, futuximab, galcanezumab, galegenimab, galiximab, gancotamab, ganitumab, gantenerumab, garadacimab, garetosmab, garivulimab, gatipotuzumab, gatralimab, gavilimomab, gedivumab, gefurulimab, gemtuzumab, geptanolimab, gevokizumab, giloralimab, gilvetmab, gimsilumab, ginisortamab, girentuximab, glembatumumab, glenzocimab, glofitamab, goflikicept, golimumab, golocdacimab, gontivimab, gosuranemab, gremubamab, gresonitamab, grisnilimab, gumokimab, guselkumab, ianalumab, ibalizumab, ibritumomab, icrucumab, idactamab, idarucizumab, ieramilimab, ifabotuzumab, ifinatamab, igovomab, iladatuzumab, imalumab, imaprelimab, imciromab, imdevimab, imgatuzumab, imsidolimab, imvotamab, inbakicept, inclacumab, indatuximab, indusatumab, inebilizumab, inezetamab, infliximab, inolimomab, inotuzumab, intetumumab, ipafricept, iparomlimab, ipilimumab, iratumumab, isatuximab, iscalimab, isecarosmab, ispectamab, istiratumab, itepekimab, itolizumab, ivicentamab, ivonescimab, ivuxolimab, ixekizumab, izalontamab, izenivetmab, izuralimab, keliximab, labetuzumab, lacnotuzumab, lacutamab, ladiratuzumab, lampalizumab, lanadelumab, landogrozumab, laprituximab, larcaviximab, latikafusp, latozinemab, lebrikizumab, lecanemab, lemalesomab, lemzoparlimab, lenercept, lenvervimab, lenzilumab, lepunafusp, lerdelimumab, leronlimab, lesabelimab, lesofavumab, letaplimab, letolizumab, levilimab, lexatumumab, libivirumab, licaminlimab, lifastuzumab, ligelizumab, ligufalimab, lilotomab, lintuzumab, linvoseltamab, lirentelimab, lirilumab, litifilimab, livmoniplimab, lodapolimab, lodelcizumab, lokivetmab, lomtegovimab, loncastuximab, lonigutamab, lorigerlimab, lorukafusp, lorvotuzumab, losatuxizumab, lucatumumab, lulizumab, lumiliximab, lumretuzumab, lupartumab, luspatercept, lusvertikimab, lutikizumab, luveltamab, maftivimab, magrolimab, manelimab, manfidokimab, mapatumumab, margetuximab, marstacimab, masavibart, maslimomab, matuzumab, mavrilimumab, mazorelvimab, mecbotamab, melredableukin, melrilimab, mepolizumab, metelimumab, mezagitamab, mibavademab, milatuzumab, minretumomab, mipasetamab, miptenalimab, mirikizumab, miromavimab, mirvetuximab, mirzotamab, mitazalimab, mitumomab, modakafusp, modotuximab, mogamulizumab, monalizumab, morolimumab, mosunetuzumab, motavizumab, moxetumomab, mupadolimab, murlentamab, muromonab, nacolomab, nadecnemab, nadunolimab, namilumab, naptumomab, naratuximab, narnatumab, narsoplimab, natalizumab, navicixizumab, navivumab, naxitamab, nebacumab, necitumumab, nemolizumab, nepuvibart, nerelimomab, nesvacumab, netakimab, nimacimab, nimotuzumab, nipocalimab, nirsevimab, nivatrotamab, nivolumab, nofazinlimab, nofetumomab, nurulimab, obexelimab, obiltoxaximab, obinutuzumab, obrindatamab, ocaratuzumab, ociperlimab, ocrelizumab, odesivimab, odronextamab, odulimomab, ofatumumab, ogalvibart, olamkicept, olaratumab, oleclumab, olendalizumab, olinvacimab, olokizumab, omalizumab, omburtamab, omodenbamab, onartuzumab, onfekafusp, ongericimab, ontamalimab, ontorpacept, ontuxizumab, onvatilimab, opicinumab, opinercept, oportuzumab, opucolimab, ordesekimab, oregovomab, orilanolimab, ormutivimab, orticumab, osemitamab, osocimab, otelixizumab, otilimab, otlertuzumab, oxelumab, ozanezumab, ozoralizumab, ozuriftamab, pabinafusp, pacanalotamab, pacmilimab, pagibaximab, palivizumab, pamrevlumab, panitumumab, panobacumab, paridiprubart, parsatuzumab, pascolizumab, pasotuxizumab, pateclizumab, patritumab, pavurutamab, pelgifatamab, pembrolizumab, penpulimab, pepinemab, perakizumab, peresolimab, pertuzumab, petosemtamab, pexelizumab, pidilizumab, pimivalimab, pimurutamab, pinatuzumab, pintumomab, pivekimab, placulumab, plamotamab, plonmarlimab, plozalizumab, plutavimab, polatuzumab, ponezumab, ponsegromab, porgaviximab, posdinemab, pozelimab, praluzatamab, prasinezumab, prezalumab, priliximab, pritoxaximab, pritumumab, prolgolimab, pucotenlimab, pulocimab, quavonlimab, quetmolimab, quilizumab, quisovalimab, racotumomab, radretumab, rafivirumab, ragifilimab, ralpancizumab, ramatercept, ramucirumab, ranevetmab, ranibizumab, ravagalimab, ravulizumab, raxibacumab, recaticimab, refanezumab, regavirumab, regdanvimab, relatlimab, relfovetmab, remtolumab, reozalimab, reslizumab, retifanlimab, retlirafusp, revdofilimab, rilonacept, rilotumumab, rimteravimab, rinucumab, ripertamab, risankizumab, rituximab, rivabazumab, robatumumab, rocatinlimab, roledumab, rolinsatamab, romilkimab, romlusevimab, romosozumab, rontalizumab, rosmantuzumab, rosnilimab, rosopatamab, rovalpituzumab, rovelizumab, rozanolixizumab, rozibafusp, rulonilimab, runimotamab, ruplizumab, sabatolimab, sacituzumab, samalizumab, samrotamab, sarilumab, sasanlimab, satralizumab, satumomab, secukinumab, selicrelumab, semorinemab, semzuvolimab, serclutamab, seribantumab, serplulimab, setoxaximab, setrusumab, sevirumab, sibeprenlimab, sibrotuzumab, sifalimumab, siltuximab, simlukafusp, simridarlimab, simtuzumab, sintilimab, siplizumab, sirexatamab, sirtratumab, sirukumab, socazolimab, sofituzumab, solanezumab, solitomab, sonelokimab, sontuzumab, sotatercept, sotevtamab, sotigalimab, sotrovimab, sozinibercept, spartalizumab, spesolimab, stamulumab, suciraslimab, sudubrilimab, sugemalimab, sulesomab, suptavumab, surzebiclimab, sutimlimab, suvizumab, suvratoxumab, tabalumab, tabituximab, tacatuzumab, tadocizumab, tafasitamab, tafolecimab, tagitanlimab, talacotuzumab, talizumab, talquetamab, tamgiblimab, tamrintamab, tamtuvetmab, tanezumab, taplitumomab, tarcocimab, tarextumab, tarlatamab, tavolimab, tebentafusp, tebotelimab, tecaginlimab, teclistamab, tefibazumab, telazorlimab, telimomab, telisotuzumab, telitacicept, temelimab, tenatumomab, teneliximab, teplizumab, tepoditamab, teprotumumab, teropavimab, tesidolumab, tesnatilimab, tezepelumab, tibulizumab, tidutamab, tifcemalimab, tigatuzumab, tilavonemab, tildrakizumab, tilogotamab, tilvestamab, timigutuzumab, timolumab, tinurilimab, tiragolumab, tirnovetmab, tislelizumab, tisotumab, tixagevimab, tocilizumab, tomaralimab, tomuzotuximab, toralizumab, toripalimab, torudokimab, tosatoxumab, tositumomab, tovetumab, tozorakimab, tralokinumab, trastuzumab, trebananib, tregalizumab, tremelimumab, trinbelimab, trontinemab, tucotuzumab, tulinercept, tusamitamab, tuvirumab, tuvonralimab, ubamatamab, ublituximab, ulenistamab, uliledlimab, ulocuplumab, unasnemab, upanovimab, upifitamab, urabrelimab, urelumab, urtoxazumab, ustekinumab, utomilumab, vadastuximab, valanafusp, vandortuzumab, vantictumab, vanucizumab, vapaliximab, varisacumab, varlilumab, vatelizumab, vedolizumab, veltuzumab, vepalimomab, vepsitamab, vesencumab, vibecotamab, vibostolimab, vilobelimab, visilizumab, visugromab, vixarelimab, vixtimotamab, vobarilizumab, vobramitamab, vofatamab, volagidemab, volociximab, vonlerolizumab, vopratelimab, vorsetuzumab, votumumab, voxalatamab, vudalimab, vulinacimab, vunakizumab, xeligekimab, xentuzumab, zagotenemab, zalifrelimab, zalutumumab, zamerovimab, zampilimab, zanidatamab, zanolimumab, zansecimab, zelminemab, zeluvalimab, zenocutuzumab, zilovertamab, ziltivekimab, zimberelimab, zinlirvimab, ziralimumab, zolbetuximab, zolimomab, and zuberitamab. The antibodies, or fragments thereof, that can be used in the IL-21 fusion proteins of the compositions and methods disclosed herein are described in, for example, Ian Wilkinson & Geoff Hale (2022). Systematic analysis of the varied designs of 819 therapeutic antibodies and Fc fusion proteins assigned international nonproprietary names. mAbs. 14:1, 2123299. DOI: 10.1080/19420862.2022.2123299., which is hereby incorporated by reference in its entirety.

In some embodiments, the antibody or binding fragment thereof used in the IL-21 fusion proteins of the compositions and methods disclosed herein is an effectorless antibody or binding fragment thereof that has an isotype selected from the group consisting of NG, DANG, LALA, and/or LALA-PG mutations.

In some embodiments, the antibody or binding fragment thereof used in the IL-21 fusion protein of the compositions and methods disclosed herein, listed by International Nonproprietary Name, is an antibody selected from the group consisting of crefmirlimab, vibostolimab, and tifcemalumab, basiliximab, daclizumab, or a binding fragment thereof.

In some embodiments, the antibody or binding fragment thereof used in the IL-21 fusion proteins of the compositions and methods disclosed herein, is an antibody or binding fragment thereof that binds an antigen selected from the group consisting of human CD8A, human TIGIT, human CD25, human ICOS, human CD160, and human BTLA.

The antibody or binding fragment thereof used in the IL-21 fusion proteins of the compositions and methods disclosed herein can comprise, for example, an amino acid sequence 80%, 90%, 95%, 96%, 97%, 98%, 99%, or 100% identical to an amino acid sequence selected from the group consisting of SEQ ID NO: 5, 6, 7, 8, 9, 10, 11, 12, 13, or 14:

```
Crefmirlimab heavy chain variable domain
                                         (SEQ ID NO: 5)
EVQLVESGGGLVQPGGSLRLSCAASGFNIKDTYIHFVRQAPGKGL

EWIGRIDPANDNTLYASKFQGKATISADTSKNTAYLQMNSLRAED

TAVYYCGRGYGYYVFDHWGQGTLVTVSS

Crefmirlimab light chain variable domain
                                         (SEQ ID NO: 6)
DVQITQSPSSLSASVGDRVTITCRTSRSISQYLAWYQQKPGKVPK

LLIYSGSTLQSGVPSRFSGSGSGTDFTLTISSLQPEDVATYYCQQ

HNENPLTFGGGTKVEIK
```

-continued

```
Vibostolimab heavy chain variable domain
                                         (SEQ ID NO: 7)
EVQLVQSGAEVKKPGSSVKVSCKASGYTFSSYVMHWVRQAPGQGL

EWIGYIDPYNDGAKYAQKFQGRVTLTSDKSTSTAYMELSSLRSED

TAVYYCARGGPYGWYFDVWGQGTTVTVSS

Vibostolimab light chain variable domain
                                         (SEQ ID NO: 8)
DIQMTQSPSSLSASVGDRVTITCRASEHIYSYLSWYQQKPGKVPK

LLIYNAKTLAEGVPSRFSGSGSGTDFTLTISSLQPEDVATYYCQH

HFGSPLTFGQGTRLEIK

Tifcemalimab heavy chain variable domain
                                         (SEQ ID NO: 9)
QVQLVQSGAEVKKPGASVKLSCKASGYNFKHTYAHWVRQAPGQGL

EWIGRIDPANGNTKYDPKFQGRATMTADTASNTAYLELSSLRSED

TAVYYCVADHYGSSLLDYWGQGTLVTVSS

Tifcemalimab light chain variable domain
                                        (SEQ ID NO: 10)
DVVMTQTPLSLSVTPGQPASISCKSSQSLLDSDGKTYLNWFQQRP

GQSPRRLIYLVSKLDSGVPDRFSGSGSGTDFTLKISRVEAEDVGV

YYCWQGTYFPYTFGQGTKLEIK

Daclizumab heavy chain variable domain
                                        (SEQ ID NO: 11)
QVQLVQSGAEVKKPGSSVKVSCKASGYTFTSYRMHWVRQAPGQGL

EWIGYINPSTGYTEYNQKFKDKATITADESTNTAYMELS SLRSE

DTAVYYCARGGGVEDYWGQGTLVTVSS

Daclizumab light chain variable domain
                                        (SEQ ID NO: 12)
DIQMTQSPSTLSASVGDRVTITCSASSSISYMHWYQQKPGKAPKL

LIYTTSNLASGVPARFSGSGSGTEFTLTISSLQPDDFATYYCHQR

STYPLTFGQGTKVEVK

Basiliximab heavy chain variable domain
                                        (SEQ ID NO: 13)
QLQQSGTVLARPGASVKMSCKASGYSFTRYWMHWIKQRPGQGLEW

IGAIYPGNSDTSYNQKFEGKAKLTAVTSASTAYMELSSLTHEDSA

VYYCSRDYGYYFDFWGQGTTLTVSS

Basiliximab light chain variable domain
                                        (SEQ ID NO: 14)
QIVSTQSPAIMSASPGEKVTMTCSASSSRSYMQWYQQKPGTSPKR

WIYDTSKLASGVPARFSGSGSGTSYSLTISSMEAEDAATYYCHQR

SSYTFGGGTKLEIK
```

The IL-21 fusion proteins as described herein can be created by methods known in the art, for example, synthetic or recombinant methods. Typically, the fusion proteins are made by preparing and expressing a polynucleotide encoding them using recombinant methods, e.g., as described herein, although they may also be prepared by other methods known in the art, including, for example, chemical synthesis methods.

The antibodies as described herein can be made by any method known in the art. For the production of hybridoma cell lines, the route and schedule of immunization of the host animal are generally in keeping with established and conventional techniques for antibody stimulation and production, as further described herein. General techniques for producing human and mouse antibodies are known in the art and/or are described herein.

It is contemplated that any mammalian subject including humans, or antibody producing cells therefrom, can be manipulated to serve as the basis for production of mammalian, including human and hybridoma cell lines. Typically, the host animal is inoculated intraperitoneally, intramuscularly, orally, subcutaneously, intraplantar, and/or intradermally with an amount of immunogen, including as described herein.

Hybridomas can be prepared from the lymphocytes and immortalized myeloma cells using the general somatic cell hybridization technique of Kohler, B. and Milstein, C., Nature 256:495-497, 1975 or as modified by Buck, D. W., et al., In Vitro, 18:377-381, 1982. Available myeloma lines, including, but not limited to, X63-Ag8.653 and those from the Salk Institute, Cell Distribution Center, San Diego, Calif., USA, can be used in the hybridization. Generally, the technique involves fusing myeloma cells and lymphoid cells using a fusogen such as polyethylene glycol, or by electrical means well known to those skilled in the art. After the fusion, the cells are separated from the fusion medium and grown in a selective growth medium, such as hypoxanthine-aminopterin-thymidine (HAT) medium, to eliminate unhybridized parent cells. Any of the media described herein, supplemented with or without serum, can be used for culturing hybridomas that secrete monoclonal antibodies. As another alternative to the cell fusion technique, EBY immortalized B cells may be used to produce the monoclonal antibodies of the subject invention. The hybridomas are expanded and subcloned, if desired, and supernatants are assayed for anti-immunogen activity by conventional immunoassay procedures (e.g., radioimmunoassay, enzyme immunoassay, or fluorescence immunoassay).

Hybridomas that can be used as a source of antibodies include all derivatives, and progeny cells, of the parent hybridomas that produce monoclonal antibodies.

Hybridomas that produce antibodies used for the present invention may be grown in vitro or in vivo using known procedures. The monoclonal antibodies may be isolated from the culture media or body fluids by conventional immunoglobulin purification procedures such as ammonium sulfate precipitation, gel electrophoresis, dialysis, chromatography, and ultrafiltration, if desired. Undesired activity, if present, can be removed, for example, by running the preparation over adsorbents made of the immunogen attached to a solid phase and eluting or releasing the desired antibodies off the immunogen. Immunization of a host animal with cells expressing the antibody target, a human target protein, or a fragment containing the target amino acid sequence conjugated to a protein that is immunogenic in the species to be immunized, e.g., keyhole limpet hemocyanin, serum albumin, bovine thyroglobulin, or soybean trypsin inhibitor using a bifunctional or derivatizing agent, for example, maleimidobenzoyl sulfosuccinimide ester (conjugation through cysteine residues), N-hydroxysuccinimide (through lysine residues), glutaraldehyde, succinic anhydride, SOC12, or R1N═C═NR, where R and R1 are different alkyl groups, can yield a population of antibodies (e.g., monoclonal antibodies).

If desired, the antibody (monoclonal or polyclonal) of interest can be sequenced and the polynucleotide sequence may then be cloned into a vector for expression or propagation. The sequence encoding the antibody of interest can be maintained in a vector in a host cell and the host cell can then be expanded and frozen for future use. Production of recombinant monoclonal antibodies in cell culture can be carried out through cloning of antibody genes from B cells by means known in the art. See, e.g., Tiller et al., J. Immunol. Methods 329, 112, 2008; U.S. Pat. No. 7,314,622.

In some embodiments, antibodies as described herein are glycosylated at conserved positions in their constant regions (Jefferis and Lund, 1997, Chem. Immunol. 65:111-128; Wright and Morrison, 1997, TibTECH 15:26-32). The oligosaccharide side chains of the immunoglobulins affect the protein's function (Boyd et al., 1996, Mol. Immunol. 32:1311-1318; Wittwe and Howard, 1990, Biochem. 29:4175-4180) and the intramolecular interaction between portions of the glycoprotein, which can affect the conformation and presented three-dimensional surface of the glycoprotein (Jefferis and Lund, supra; Wyss and Wagner, 1996, Current Opin. Biotech. 7:409-416).

Oligosaccharides may also serve to target a given glycoprotein to certain molecules based upon specific recognition structures. Glycosylation of antibodies has also been reported to affect antibody-dependent cellular cytotoxicity (ADCC). In particular, antibodies produced by CHO cells with tetracycline-regulated expression of ~(1,4)-N-acetylglucosaminyltransferase III (GnTIII), a glycosyltransferase catalyzing formation of bisecting GicNAc, was reported to have improved ADCC activity (Umana et al., 1999, Nature Biotech. 17:176-180).

Glycosylation of antibodies is typically either N-linked or O-linked. N-linked refers to the attachment of the carbohydrate moiety to the side chain of an asparagine residue. The tripeptide sequences asparagine-X-serine, asparagine-X-threonine, and asparagine-X-cysteine, where X is any amino acid except praline, are the recognition sequences for enzymatic attachment of the carbohydrate moiety to the asparagine side chain. Thus, the presence of either of these tripeptide sequences in a polypeptide creates a potential glycosylation site. O-linked glycosylation refers to the attachment of one of the sugars N-acetylgalactosamine, galactose, or xylose to a hydroxyamino acid, most commonly serine or threonine, although 5-hydroxyproline or 5-hydroxylysine may also be used.

Addition of glycosylation sites to the antibody is conveniently accomplished by altering the amino acid sequence such that it contains one or more of the tripeptide sequences (for N-linked glycosylation sites) described above. The alteration may also be made by the addition of, or substitution by, one or more serine or threonine residues to the sequence of the original antibody (for O-linked glycosylation sites).

The glycosylation pattern of antibodies can also be altered without altering the underlying nucleotide sequence. Glycosylation largely depends on the host cell used to express the antibody. Since the cell type used for expression of recombinant glycoproteins, e.g., antibodies, as potential therapeutics is rarely the native cell, variations in the glycosylation pattern of the antibodies can be expected (see, e.g., Hse et al., 1997, J. Biol. Chem. 272:9062-9070).

In addition to the choice of host cells, factors that affect glycosylation during recombinant production of antibodies include growth mode, media formulation, culture density, oxygenation, pH, purification schemes, and the like.

Various methods have been proposed to alter the glycosylation pattern achieved in a particular host organism including introducing or overexpressing certain enzymes involved in oligosaccharide production (U.S. Pat. Nos. 5,047,335; 5,510,261 and 5,278,299). Glycosylation, or certain types of glycosylation, can be enzymatically removed from the glycoprotein, for example, using endoglycosidase H (Endo H), N-glycosidase F, endoglycosidase F 1, endoglycosidase F2, endoglycosidase F3. In addition, the recombinant host cell can be genetically engineered to be defective in processing certain types of polysaccharides. These and similar techniques are well known in the art.

Other methods of modification include using coupling techniques known in the art, including, but not limited to, enzymatic means, oxidative substitution, and chelation. Modifications can be used, for example, for attachment of labels for immunoassay. Modified polypeptides are made using established procedures in the art and can be screened using standard assays known in the art, some of which are described below and in the Examples.

The IL-21 fusion proteins and/or the IL-21 variants of this disclosure may be linked to a labeling agent such as a fluorescent molecule, a radioactive molecule, or any other labels known in the art. Labels are known in the art that provide (either directly or indirectly) a signal.

In some embodiments, the IL-21 fusion protein includes an antibody including or consisting of an Fc domain and an IL-21 variant having one or more specific substitutions at one or more, e.g., two or more, or three or more, or four or more, or five or more, or six or more, or seven or more, or eight or more, or nine or more, or ten or more of positions Q32, D33, R34, H35, M36, 137, R38, M39, Q41, L42, 143, D44, 145, V46, D47, Q48, L49, N51, Y52, V53, N54, L56, V57, E59, F60, L61, P62, A63, D66, E68, N70, E72, W73, S74, A75, F76, S77, F79, Q80, K85, S86, A87, N88, T89, E93, R94, 195, 196, N97, V98, S99, 1100, L103, K104, R105, K106, P107, P108, S109, A112, R114, R115, H118, L120, K131, P132, P133, R139, S142, Q145, 1148, Q150, H151, and L152 in the wild-type human IL-21 amino acid sequence (SEQ ID NO: 1).

In some embodiments, the IL-21 fusion protein includes an antibody including or consisting of a Fc domain and an IL-21 variant comprising one or more, e.g., two or more, or three or more, or four or more, or five or more, or six or more, or seven or more, or eight or more, or nine or more, or ten or more specific substitutions selected from the group consisting of: Q32K, D33A, D33N, D33P, D33Q, D33R, D33S, D33T, R34A, R34D, R34E, R34F, R34G, R34H, R34K, R34L, R34M, R34N, R34P, R34Q, R34S, R34T, R34V, R34W, R34Y, H35P, M36T, 137E, 137G, 137K, 137N, I37Q, 137R, 137S, I37V, R38A, R38E, R38F, R38K, R38M, R38Q, R38V, M39D, M39E, M39G, M39I, M39K, M39P, M39Q, M39R, Q41K, Q41P, Q41S, L42D, L42E, L42G, L42H, L42K, L42N, L42Q, L42R, L42S, L42Y, I43D, I43L, I43M, I43P, I43S, D44A, D44G, D44N, D44P, D44T, I45A, I45D, I45G, I45H, I45N, I45P, I45R, I45S, I45Y, V46D, V46E, V46G, V46K, V46N, V46P, V46Q, V46T, D47P, D47S, Q48G, Q48K, L49D, L49E, L49H, L49K, L49N, L49P, L49R, L49S, N51E, N51G, N51P, N51V, Y52D, Y52H, Y52K, Y52N, Y52Q, V53A, V53E, V53H, V53N, V53P, V53Q, V53S, V53T, N54H, N54K, N54P, L56E, L56F, L56M, L56N, L56S, L56T, V57H, V57L, V57M, V57P, V57R, V57T, V57Y, E59R, E59S, F60H, F60I, F60R, L61H, L61I, P62H, P62S, P62T, P62V, A63T, D66M, D66R, E68K, E68R, N70A, N70H, E72H, E72I, E72L, E72S, E72T, W73A, W73G, W73K, W73L, W73N, W73P, W73Q, W73S, W73T, W73V, W73Y, S74A, S74H, S74N, A75N, F76D, F76E, F76H, F76M, F76P, F76Q, F76R, F76T, S77K, S77M, S77R, F79D, F79E, F79K, F79P, F79R, F79T, F79Y, Q80A, Q80D, K85S, S86I, A87N, N88K, T89L, E93G, E93T, R94S, R94T, I95H, I95K, I95P, I95T, I96A, I96D, I96G, I96P, I96S, I96T, I96V, N97G, V98H, V98K, V98R, S99H, I100E, L103E, K104G, R105A, R105D, R105K, R105Q, R105S, R105W, K106E, K106N, K106P, K106S, K106T, P107D, P107Y, P108D, P108E, P108G, P108I, P108L, P108Q, P108T, S109K, S109M, S109R, A112P, A112R, R114F, R115I, R115P, R115Q, H118I, H118K, H118R, L120H, L120K, L120M, L120V, L120Y, K131M, K131V, P132A, P133I, R139S, S142D, S142H, S142I, Q145H, 1148S, Q150D, Q150R, Q150S, H151E, and L152H in the wild-type human IL-21 amino acid sequence (SEQ ID NO: 1).

In some embodiments, the IL-21 fusion protein includes an antibody including or consisting of an Fc domain and an IL-21 variant having one or more specific substitutions at one or more, e.g., two or more, three or more, four or more, five or more, six or more, seven or more, eight or more, or nine or more, of positions H35, N91, K101, N111, R114, R115, H118, R119, T121 in the wild-type human IL-21 amino acid sequence (SEQ ID NO: 1).

In some embodiments, the IL-21 fusion protein includes an antibody including or consisting of a Fc domain and an IL-21 variant comprising one or more, e.g., two or more, or three or more, or four or more, or five or more, or six or more, or seven or more, or eight or more, or nine or more specific substitutions selected from the group consisting of H35F, N91E, K101E, N111E, R114G, R115G, H118D, R119T, and T121E in the wild-type human IL-21 amino acid sequence (SEQ ID NO: 1).

In some embodiments, the IL-21 fusion protein includes an antibody including or consisting of a Fc domain and an IL-21 variant comprising the amino acid substitutions H35F, N91E, K101E, N111E, R114G, R115G, H118D, R119T, and T121E in the wild-type human IL-21 amino acid sequence (SEQ ID NO: 1). In some embodiments, the IL-21 fusion protein includes an antibody including or consisting of a Fc domain and an IL-21 variant comprising the amino acid substitutions H35F, N91E, and K101E in the wild-type human IL-21 amino acid sequence (SEQ ID NO: 1). In some embodiments, the IL-21 fusion protein includes an antibody including or consisting of a Fc domain and an IL-21 variant comprising the amino acid substitutions N111E, R114G, R115G, H118D, R119T, and T121E in the wild-type human IL-21 amino acid sequence (SEQ ID NO: 1). In some embodiments, the IL-21 fusion protein includes an antibody including or consisting of a Fc domain and an IL-21 variant comprising the amino acid substitutions N111E, R115G, H118D, and T121E in the wild-type human IL-21 amino acid sequence (SEQ ID NO: 1).

In some embodiments, the IL-21 fusion protein includes an antibody including or consisting of a Fc domain and an IL-21 variant comprising the amino acid substitutions H35F, R114G, R115G, H118D, R119T, and T121E in the wild-type human IL-21 amino acid sequence (SEQ ID NO: 1).

In some embodiments, the IL-21 fusion protein includes an antibody including or consisting of an Fc domain and an IL-21 variant having one or more specific substitutions at one or more, e.g., two or more, three or more, four or more, five or more, six or more, seven or more, eight or more, nine or more, ten or more, 11 or more, 12 or more, or 13 of positions H35, I45, N70, K81, V98, P107, T110, A112, R114, R115, H118, R119, T121 in the wild-type human IL-21 amino acid sequence (SEQ ID NO: 1).

In some embodiments, the IL-21 fusion protein includes an antibody including or consisting of an Fc domain and an IL-21 variant having one or more specific substitutions at one or more, e.g., two or more, three or more, four or more, five or more, six or more, seven or more, eight or more, nine or more, ten or more, 11 or more, 12 or more, 13 or more, 14 or more, 15 or more, or 16 specific substitutions selected from the group consisting of H35F, H35I, I45T, N70G, K81D, V98E, P107V, T110D, A112P, R114Q, R114G, R115D, R115G, H118D, R119T, and T121E in the wild-type human IL-21 amino acid sequence (SEQ ID NO: 1).

In some embodiments, the IL-21 fusion protein has a binding affinity to human IL-21R that is decreased by 1.5-fold, 2-fold, 3-fold, 5-fold, 10-fold, 50-fold, 100-fold, 500-fold, 1000-fold, 2000-fold, or 3000-fold, or more relative to the binding affinity between the wild-type human IL-21 polypeptide and the human IL-21R.

Polynucleotides, Vectors, Host Cells

The disclosure also provides polynucleotides encoding any of the IL-21 variants and IL-21 fusion proteins as described herein. In one aspect, the disclosure provides methods of making any of the polynucleotides described herein. Polynucleotides can be made and expressed by procedures known in the art.

In another aspect, the disclosure provides compositions (such as pharmaceutical compositions) including any of the polynucleotides described herein. In some embodiments, the composition includes an expression vector having a polynucleotide encoding any of the IL-21 variants and IL-21 fusion proteins described herein.

In another aspect, the disclosure provides isolated cell lines that produce the IL-21 variants and the IL-21 fusion proteins as described herein. In some embodiments, the cell line is an engineered immune cell, wherein the engineered immune cell includes a chimeric antigen receptor (CAR). In some embodiments, the IL-21 variants and the IL-21 fusion proteins, when expressed as polynucleotides in CAR T cells, either as secreted or membrane-tethered versions, are used to enhance CAR T function, including activity and proliferation.

Immune cells producing the IL-21 variants and the IL-21 fusion proteins as described herein can be made by introducing a CAR into immune cells, and expanding the cells. For example, the immune cells can be engineered by providing a cell and expressing at the surface of the cell at least one CAR and at least one IL-21 variant or IL-21 fusion protein as described herein. Methods for engineering immune cells are described in, for example, PCT Patent Application Publication Nos. WO/2014/039523, WO/2014/184741, WO/2014/191128, WO/2014/184744, and WO/2014/184143, each of which is incorporated herein by reference in its entirety. In some embodiments, the cell can be transformed with at least one polynucleotide encoding a CAR, one polynucleotide encoding the IL-21 variant or IL-21 fusion protein as described herein, followed by expressing the polynucleotides in the cell.

Polynucleotides complementary to any such sequences are also encompassed by the present invention. Polynucleotides may be single-stranded (coding or antisense) or double-stranded, and may be DNA (genomic, cDNA or synthetic) or RNA molecules. RNA molecules include HnRNA molecules, which contain introns and correspond to a DNA molecule in a one-to-one manner, and mRNA molecules, which do not contain introns. Additional coding or non-coding sequences may, but need not, be present within a polynucleotide described herein, and a polynucleotide may, but need not, be linked to other molecules and/or support materials. Polynucleotides can include a native sequence (e.g., an endogenous sequence that encodes an antibody or a fragment thereof) or may include a variant of such a sequence. Polynucleotide variants of antibodies or fragments thereof contain one or more substitutions, additions, deletions, and/or insertions such that the immunoreactivity of the encoded polypeptide is not diminished, relative to a native immunoreactive molecule. The effect on the immunoreactivity of the encoded polypeptide may generally be assessed as described herein and by methods known in the relevant field. Variants of antibodies or fragments thereof can exhibit at least about 70% identity, at least about 80% identity, at least about 90% identity, or at least about 95, 96, 97, 98, or 99% identity to a polynucleotide sequence that encodes a native antibody or a fragment thereof.

Variants are substantially homologous to a native gene, or a portion or complement thereof. It will be appreciated by those of ordinary skill in the art that, because of the degeneracy of the genetic code, there are many nucleotide sequences that encode polypeptides as described herein. Some of these polynucleotides bear minimal homology to the nucleotide sequence of any native gene. Nonetheless, polynucleotides that vary due to differences in codon usage are specifically contemplated by the present invention. Further, alleles of the genes comprising the polynucleotide sequences provided herein are within the scope of the present invention. Alleles are endogenous genes that are altered because of one or more mutations, such as deletions, additions and/or substitutions of nucleotides. The resulting mRNA and protein may, but need not, have an altered structure or function. Alleles may be identified using standard techniques (such as hybridization, amplification and/or database sequence comparison).

The polynucleotides of this disclosure can be obtained using chemical synthesis, recombinant methods, or PCR. Methods of chemical polynucleotide synthesis are well known in the art and need not be described in detail herein. One of skill in the art can use the sequences provided herein and a commercial DNA synthesizer to produce a desired DNA sequence. For preparing polynucleotides using recombinant methods, a polynucleotide having a desired sequence can be inserted into a suitable vector, and the vector in turn can be introduced into a suitable host cell for replication and amplification, as further discussed herein. Polynucleotides can be inserted into host cells by any means known in the art. Cells are transformed by introducing an exogenous polynucleotide by direct uptake, endocytosis, transfection, F-mating, or electroporation. Once introduced, the exogenous polynucleotide can be maintained within the cell as a non-integrated vector (such as a plasmid) or integrated into the host cell genome. The polynucleotide so amplified can be isolated from the host cell by methods well known within the art. See, e.g., Sambrook et al., 1989.

As is well known, PCR allows reproduction of DNA sequences. See, e.g. U.S. Pat. Nos. 4,683,195, 4,800,159, 4,754,065 and 4,683,202, as well as PCR: The Polymerase Chain Reaction, Mullis et al. eds., Birkauswer Press, Boston, 1994. RNA can be obtained by using isolated DNA in an appropriate vector and inserting it into a suitable host cell. When the cell replicates and the DNA is transcribed into RNA, the RNA can then be isolated using methods well known to those of skill in the art, as set forth in Sambrook et al., 1989, supra, for example.

Suitable cloning vectors can be constructed according to standard techniques, or may be selected from a large number of cloning vectors available in the art. While the cloning vector selected may vary according to the host cell intended to be used, useful cloning vectors will generally have the ability to self-replicate, may possess a single target for a particular restriction endonuclease, and/or may carry genes for a marker that can be used in selecting clones containing the vector. Suitable examples include plasmids and bacterial viruses, e.g., pUC18, pUC19, Bluescript (e.g., pBS SK+) and its derivatives, mp 18, mp 19, pBR322, pMB9, ColE1, pCRl, RP4, phage DNAs, and shuttle vectors such as pSA3 and pAT28. These and many other cloning vectors are available from commercial vendors such as BioRad, Strategene, and Invitrogen.

Expression vectors are also provided herein. Expression vectors generally are replicable polynucleotide constructs that contain a polynucleotide as described herein. It is implied that an expression vector must be replicable in the host cells either as episomes or as an integral part of the chromosomal DNA. Suitable expression vectors include but are not limited to plasmids, viral vectors, including adenoviruses, adeno-associated viruses, retroviruses, cosmids, and expression vector(s) disclosed in PCT Publication No. WO 87/04462. Vector components generally include, but are not limited to, one or more of the following: a signal sequence; an origin of replication; one or more marker genes; suitable transcriptional controlling elements (such as promoters, enhancers and terminator). For expression (i.e., translation), one or more translational controlling elements are also usually required, such as ribosome binding sites, translation initiation sites, and stop codons.

The vectors containing the polynucleotides of interest can be introduced into the host cell by any of a number of appropriate methods, including electroporation, transfection employing calcium chloride, rubidium chloride, calcium phosphate, DEAE-dextran, or other substances; microprojectile bombardment; lipofection; and infection (e.g., where the vector is an infectious agent such as vaccinia virus). The choice of how to introduce vectors or polynucleotides into cells will often depend on features of the host cell.

The disclosure also provides host cells including any of the polynucleotides described herein. Any host cells capable of over-expressing heterologous DNAs can be used for the purpose of isolating the genes encoding the antibody, polypeptide, or protein of interest. Non-limiting examples of mammalian host cells include but not limited to COS, HeLa, and CHO cells. See also PCT Publication No. WO 87/04462. Suitable non-mammalian host cells include prokaryotes (such as *E. coli* or *B. subtilis*) and yeast (such as *S. cerevisae, S. pombe*; or *K. lactis*). Preferably, the host cells express the cDNAs at a level of about 5 fold higher, 10 fold higher, or 20 fold higher than that of the corresponding endogenous antibody or protein of interest, if present, in the host cells. Screening the host cells for a specific binding to IL-21 or a IL-21 domain can be effected by an immunoassay or FACS. A cell overexpressing the antibody or protein of interest can be identified.

An expression vector can be used to direct expression of an IL-21 variant or an IL-21 fusion protein. One skilled in the art is familiar with administration of expression vectors to obtain expression of an exogenous protein in vivo. See, e.g., U.S. Pat. Nos. 6,436,908; 6,413,942; and 6,376,471. Administration of expression vectors includes local or systemic administration, including injection, oral administration, particle gun, catheterized administration, and topical administration. In another embodiment, the expression vector is administered directly to the sympathetic trunk or ganglion, or into a coronary artery, atrium, ventricle, or pericardium.

Targeted delivery of therapeutic compositions containing an expression vector, or subgenomic polynucleotides can also be used. Receptor-mediated DNA delivery techniques are described in, for example, Findeis et al., Trends Biotechnol., 1993, 11:202; Chiou et al., Gene Therapeutics: Methods And Applications Of Direct Gene Transfer, J. A. Wolff, ed., 1994; Wu et al., J. Biol. Chem., 1988, 263:621; Wu et al., J. Biol. Chem., 1994, 269:542; Zenke et al., Proc. Natl. Acad. Sci. USA, 1990, 87:3655; Wu et al., J. Biol. Chem., 1991, 266:338.

Therapeutic compositions containing a polynucleotide are administered in a range of about 100 ng to about 200 mg of DNA for local administration in a gene therapy protocol. Concentration ranges of about 500 ng to about 50 mg, about 1 pg to about 2 mg, about 5 pg to about 500 pg, and about 20 pg to about 100 pg of DNA can also be used during a gene therapy protocol. The therapeutic polynucleotides and polypeptides can be delivered using gene delivery vehicles. The gene delivery vehicle can be of viral or non-viral origin (see generally, Jolly, Cancer Gene Therapy, 1994, 1:51; Kimura, Human Gene Therapy, 1994, 5:845; Connelly, Human Gene Therapy, 1995, 1:185; and Kaplitt, Nature Genetics, 1994, 6:148).

Expression of such coding sequences can be induced using endogenous mammalian or heterologous promoters. Expression of the coding sequence can be either constitutive or regulated. Viral-based vectors for delivery of a desired polynucleotide and expression in a desired cell are well known in the art. Exemplary viral-based vehicles include, but are not limited to, recombinant retroviruses (see, e.g., PCT Publication Nos. WO 90/07936: WO 94/03622; WO 93/25698; WO 93/25234; WO 93/11230; WO 93/10218; WO 91/02805; U.S. Pat. Nos. 5,219,740 and 4,777,127; GB Patent No. 2,200,651; and EP Patent No. 0345 242), alphavirus-based vectors (e.g., Sindbis virus vectors, Semliki forest virus (ATCC VR-67; ATCC VR-1247), Ross River virus (ATCC VR-373; ATCC VR-1246) and Venezuelan equine encephalitis virus (ATCC VR-923; ATCC VR-1250; ATCC VR 1249; ATCC VR-532)), and adeno-associated virus (AAV) vectors (see, e.g., PCT Publication Nos. WO 94/12649, WO 93/03769; WO 93/19191; WO 94/28938; WO 95/11984 and WO 95/00655). Administration of DNA linked to killed adenovirus as described in Curiel, Hum. Gene Ther., 1992, 3:147 can also be employed.

Non-viral delivery vehicles and methods can also be employed, including, but not limited to, polycationic condensed DNA linked or unlinked to killed adenovirus alone (see, e.g., Curiel, Hum. Gene Ther., 1992, 3:147); ligand-linked DNA (see, e.g., Wu, J. Biol. Chem., 1989, 264: 16985); eukaryotic cell delivery vehicles cells (see, e.g., U.S. Pat. No. 5,814,482; PCT Publication Nos. WO 95/07994; WO 96/17072; WO 95/30763; and WO 97/42338) and nucleic charge neutralization or fusion with cell membranes. Naked DNA can also be employed. Exemplary naked DNA introduction methods are described in PCT Publication No. WO 90/11092 and U.S. Pat. No. 5,580,859. Liposomes that can act as gene delivery vehicles are described in U.S. Pat. No. 5,422,120; PCT Publication Nos. WO 95/13796; WO 94/23697; WO 91/14445; and EP 0524968. Additional approaches are described in Philip, Mol. Cell Biol., 1994, 14:2411, and in Woffendin, Proc. Natl. Acad. Sci., 1994, 91:1581.

Compositions

The disclosure also provides pharmaceutical compositions including an effective amount of an IL-21 variant or an IL-21 fusion protein as described herein. Examples of such compositions, as well as how to formulate, are also described herein. In some embodiments, the composition includes one or more IL-21 variants, combinations with one or more other variant detuned cytokines and/or other IL-21 fusion proteins.

In some embodiments, the compositions include an IL-21 fusion protein including an antibody and a human IL-21 variant having one or more, e.g., two or more, or three or more, or four or more, or five or more, or six or more, or seven or more, or eight or more, or nine or more, or ten or more specific substitutions in SEQ ID NO: 1 as described herein.

In certain embodiments, the compositions can include more than one IL-21 variant or IL-21 fusion protein (e.g., a mixture of IL-21 variants or IL-21 fusion proteins comprising different IL-21 variants and/or different antibodies).

The compositions disclosed herein can further include pharmaceutically acceptable carriers, excipients, or stabilizers (Remington: The Science and practice of Pharmacy 20th Ed., 2000, Lippincott Williams and Wilkins, Ed. K. E. Hoover), in the form of lyophilized formulations or aqueous solutions. Acceptable carriers, excipients, or stabilizers are nontoxic to recipients at known dosages and concentrations, and may include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrans; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™, or polyethylene glycol (PEG). Pharmaceutically acceptable excipients are further described herein.

The IL-21 variants, IL-21 fusion proteins, and compositions thereof can also be used in conjunction with, or administered separately, simultaneously, or sequentially with other agents that serve to enhance and/or complement the effectiveness of the agents. The disclosure also provides compositions, including pharmaceutical compositions, including any of the polynucleotides described herein. In some embodiments, the compositions include an expression vector including a polynucleotide encoding the IL-21 variants and IL-21 fusion proteins as described herein. In other embodiments, the compositions include an expression vector having a polynucleotide encoding any of the IL-21 variants and IL-21 fusion proteins described herein.

Methods of Treatment

The IL-21 variants and the IL-21 fusion proteins described herein are useful in various applications including, but are not limited to, therapeutic treatment methods and diagnostic treatment methods.

In one aspect, the disclosure provides methods for treating cancer. In some embodiments, the methods of treating cancer in a subject include administering to the subject in need thereof a therapeutically effective amount, e.g., an amount effective to provide a reduction in tumor size or volume over time, and/or an amount effective to reduce one or more symptoms caused by the cancer, of a composition (e.g., a pharmaceutical composition) including any of the IL-21 variants and the IL-21 fusion proteins as described herein. As used herein, a cancer can be a solid cancer or a blood or bone marrow cancer. Solid cancers include, but are not limited to, gastric cancer, small intestine cancer, sarcoma, head and neck cancer (e.g., squamous cell head and neck cancer), thymic cancer, epithelial cancer, salivary cancer, liver cancer, biliary cancer, neuroendocrine tumors, stomach cancer, thyroid cancer, lung cancer, mesothelioma, ovarian cancer, breast cancer, prostate cancer, esophageal cancer, pancreatic cancer, glioma, renal cancer (e.g., renal cell carcinoma), bladder cancer, cervical cancer, uterine cancer, vulvar cancer, penile cancer, testicular cancer, anal cancer, choriocarcinoma, colorectal cancer, oral cancer, skin cancer, Merkel cell carcinoma, glioblastoma, brain tumor, bone cancer, eye cancer, and melanoma.

Blood and bone marrow cancers include, but are not limited to, multiple myeloma, malignant plasma cell neoplasm, Hodgkin's lymphoma, nodular lymphocyte predominant Hodgkin's lymphoma, Kahler's disease and Myelomatosis, plasma cell leukemia, plasmacytoma, B-cell prolymphocytic leukemia, hairy cell leukemia, B-cell non-Hodgkin's lymphoma (NHL), acute myeloid leukemia (AML), chronic lymphocytic leukemia (CLL), acute lymphocytic leukemia (ALL), chronic myeloid leukemia (CML), follicular lymphoma, Burkitt's lymphoma, marginal zone lymphoma, mantle cell lymphoma, large cell lymphoma, precursor B-lymphoblastic lymphoma, myeloid leukemia, Waldenstrom's macroglobulienemia, diffuse large B cell lymphoma, follicular lymphoma, marginal zone lymphoma, mucosa-associated lymphatic tissue lymphoma, small cell lymphocytic lymphoma, mantle cell lymphoma, Burkitt lymphoma, primary mediastinal (thymic) large B-cell lymphoma, lymphoplasmactyic lymphoma, Waldenstrom macroglobulinemia, nodal marginal zone B cell lymphoma, splenic marginal zone lymphoma, intravascular large B-cell lymphoma, primary effusion lymphoma, lymphomatoid granulomatosis, T cell histiocyte-rich large B-cell lymphoma, primary central nervous system lymphoma, primary cutaneous diffuse large B-cell lymphoma (leg type), EBY positive diffuse large B-cell lymphoma of the elderly, diffuse large B-cell lymphoma associated with inflammation, intravascular large B-cell lymphoma, ALK-positive large B-cell lymphoma, plasmablastic lymphoma, large B-cell lymphoma arising in HHVS-associated multicentric Castleman disease, B-cell lymphoma unclassified with features intermediate between diffuse large B-cell lymphoma and Burkitt lymphoma, B-cell lymphoma unclassified with features intermediate between diffuse large B-cell lymphoma and classical Hodgkin lymphoma, and other hematopoietic cell related cancer. In some embodiments, the cancer is relapsed, refractory, or metastatic.

In some embodiments, the methods of inhibiting tumor growth or progression in a subject include administering to the subject in need thereof an effective amount, e.g., a therapeutically effective amount, of a composition including the IL-21 variants or IL-21 fusion proteins as described herein. In some embodiments, the disclosure includes methods of inhibiting metastasis of cancer cells in a subject, which include administering to a subject in need thereof an effective amount of a composition including any of the IL-21 variants or IL-21 fusion proteins as described herein. In other embodiments, the disclosure includes methods of inducing regression of a tumor in a subject, which include administering to the subject in need thereof an effective amount of a composition including any of the IL-21 variants or IL-21 fusion proteins as described herein. In another aspect, the disclosure provides methods of detecting, diagnosing, and/or monitoring a cancer. For example, the IL-21 variants or IL-21 fusion proteins as described herein can be labeled with a detectable moiety such as an imaging agent and an enzyme-substrate label. The IL-21 variants or IL-21 fusion proteins as described herein can also be used for in vivo diagnostic assays, such as in vivo imaging (e.g., PET or SPECT), or a staining reagent.

In some embodiments, the methods described herein further include a step of treating a subject with an additional form of therapy. In some embodiments, the additional form of therapy is an additional anti-cancer therapy including, but not limited to, chemotherapy, radiation, surgery, hormone therapy, checkpoint inhibitor therapy, and/or additional immunotherapy.

With respect to all methods described herein, reference to IL-21 variants or IL-21 fusion proteins also includes compositions comprising one or more additional agents. These compositions may further comprise suitable excipients, such as pharmaceutically acceptable excipients including buffers, which are well known in the art. The methods and compositions described herein can be used alone or in combination with other methods of treatment.

The IL-21 variants and/or IL-21 fusion proteins as described herein can be administered to a subject via any suitable route. It should be apparent to a person skilled in the art that the examples described herein are not intended to be limiting, but to be illustrative of the techniques available. Accordingly, in some embodiments, the IL-21 variant or IL-21 fusion protein is administered to a subject in accord with known methods, such as intravenous administration, e.g., as a bolus or by continuous infusion over a period of time, by intramuscular, intraperitoneal, intracerebrospinal, transdermal, subcutaneous, intra-articular, sublingually, or intrasynovial administration, or via insufflation, intrathecal, oral, inhalation, or topical routes. Administration can be systemic, e.g., intravenous administration, or localized. Commercially available nebulizers for liquid formulations, including jet nebulizers and ultrasonic nebulizers are useful for administration. Liquid formulations can be directly nebulized, and lyophilized powder can be nebulized after reconstitution. Alternatively, the IL-21 variants or IL-21 fusion proteins can be aerosolized using a fluorocarbon formulation and a metered dose inhaler, or inhaled as a lyophilized and milled powder.

In some embodiments, an IL-21 variant or IL-21 fusion protein is administered via site-specific or targeted local delivery techniques. Examples of site-specific or targeted local delivery techniques include direct injection into patient tumor or various implantable depot sources of the IL-21 variants or IL-21 fusion proteins or local delivery catheters, such as infusion catheters, indwelling catheters, or needle catheters, synthetic grafts, adventitial wraps, shunts and stents or other implantable devices, site specific carriers, direct injection, or direct application. See, e.g., PCT Publication No. WO 00/53211 and U.S. Pat. No. 5,981,568.

Various formulations of an IL-21 variant or IL-21 fusion protein can be used for administration. In some embodiments, the IL-21 variant or IL-21 fusion protein can be administered neat. In some embodiments, the IL-21 variant or IL-21 fusion protein and a pharmaceutically acceptable excipient may be in various formulations. Pharmaceutically acceptable excipients are known in the art and are relatively inert substances that facilitate administration of a pharmacologically effective substance. For example, an excipient can give form or consistency, or act as a diluent. Suitable excipients include but are not limited to stabilizing agents, wetting and emulsifying agents, salts for varying osmolarity, encapsulating agents, buffers, and skin penetration enhancers. Excipients as well as formulations for parenteral and nonparenteral drug delivery are set forth in Remington, The Science and Practice of Pharmacy 20th Ed. Mack Publishing, 2000. In some embodiments, these agents are formulated for administration by injection (e.g., intraperitoneally, intravenously, subcutaneously, intramuscularly, etc.). Accordingly, these agents can be combined with pharmaceutically acceptable vehicles such as saline, Ringer's solution, dextrose solution, and the like. The particular dosage regimen, i.e., dose, timing and repetition, will depend on the particular individual and that individual's medical history.

Generally, for administration of IL-21 variants or IL-21 fusion proteins, the candidate dosage can be administered daily, every other day, every third day, every week, every other week, every three weeks, every four weeks, every five weeks, every six weeks, every seven weeks, every eight weeks, every ten weeks, every twelve weeks, or more than every twelve weeks. For repeated administrations over several days or longer, depending on the condition, the treatment is sustained until a desired suppression of symptoms occurs or until sufficient therapeutic levels are achieved, for example, to reduce symptoms associated with cancer. The progress of this therapy is easily monitored by conventional techniques and assays. The dosing regimen (including the specific IL-21 variants or IL-21 fusion proteins used) can vary over time.

In some embodiments, the candidate dosage is administered daily, weekly, every two weeks, every three weeks, every four weeks, or monthly, with the dosage ranging from about 0.01 mg/kg, about 0.1 mg/kg, about 1 mg/kg, about 10 mg/kg, about 50 mg/kg, to about 100 mg/kg, or dosages therebetween.

In some embodiments, the candidate dosage is administered daily, weekly, every two weeks, every three weeks, every four weeks, or monthly, with the administered unit dosage ranging from about 0.01 mg, about 0.1 mg, about 1 mg, about 10 mg, about 50 mg, about 100 mg, to about 1000 mg, or dosages therebetween.

For the purposes of the present disclosure, the appropriate dosage of an IL-21 variant or an IL-21 fusion protein will depend on the IL-21 variant or an IL-21 fusion protein (or compositions thereof) employed, the type and severity of symptoms to be treated, whether the agent is administered for preventive or therapeutic purposes, previous therapy, the patient's clinical history and response to the agent, the patient's clearance rate for the administered agent, and the discretion of the attending physician. Typically, the clinician will administer an IL-21 variant or an IL-21 fusion protein until a dosage is reached that achieves the desired result. Dose and/or frequency can vary over the course of treatment. In some embodiments, step dosing is performed where the initial dose or doses are lower than incrementally higher doses administered as the regimen continues. Empirical considerations, such as the half-life, generally will contribute to the determination of the dosage. Frequency of administration may be determined and adjusted over the course of therapy, and is generally, but not necessarily, based on treatment and/or suppression and/or amelioration and/or delay of symptoms. Alternatively, sustained continuous release formulations of IL-21 variants or IL-21 fusion proteins may be appropriate. Various formulations and devices for achieving sustained release are known in the art.

In one embodiment, dosages for an IL-21 variant or an IL-21 fusion protein may be determined empirically in individuals who have been given one or more administration(s) of an IL-21 variant or an IL-21 fusion protein. For example, individuals are given incremental dosages of an IL-21 variant or an IL-21 fusion protein. To assess efficacy, an indicator of the disease can be followed. Administration of an IL-21 variant or an IL-21 fusion protein as described herein in accordance with the method in the present invention can be continuous or intermittent, depending, for example, upon the recipient's physiological condition, whether the purpose of the administration is therapeutic or prophylactic, and other factors known to skilled practitioners. The administration of an IL-21 variant or an IL-21 fusion protein may be essentially continuous over a preselected period of time or may be in a series of spaced doses. In some embodiments, more than one IL-21 variant or IL-21 fusion protein may be present. At least one, at least two, at least three, at least four, at least five, or more different IL-21 variants or IL-21 fusion proteins can be present. Generally, those IL-21 variants or IL-21 fusion proteins may have complementary activities that do not adversely affect each other.

In some embodiments, the IL-21 variant or the IL-21 fusion protein may be administered in combination with one or more additional therapeutic agents. These include, but are not limited to, a biotherapeutic agent, a chemotherapeutic agent, a vaccine, a CAR-T cell-based therapy, radiotherapy, another cytokine therapy (e.g., immunostimulatory cytokines including various signaling proteins that stimulate immune response, such as interferons, interleukins, and hematopoietic growth factors), a vaccine, an inhibitor of other immunosuppressive pathways, e.g., anti-PD-1 checkpoint inhibitors, an inhibitors of angiogenesis, a T cell activator, an inhibitor of a metabolic pathway, an mTOR (mechanistic target of rapamycin) inhibitor (e.g., rapamycin, rapamycin derivatives, sirolimus, temsirolimus, everolimus, and deforolimus), an inhibitor of an adenosine pathway, a tyrosine kinase inhibitor including but not limited to inlyta, ALK (anaplastic lymphoma kinase) inhibitors (e.g., crizotinib, ceritinib, alectinib, and sunitinib), a BRAF inhibitor (e.g., vemurafenib and dabrafenib), an epigenetic modifier, an inhibitors or depletor of Treg cells and/or of myeloid-derived suppressor cells, a JAK (Janus Kinase) inhibitor (e.g., ruxolitinib and tofacitinb, varicitinib, filgotinib, gandotinib, lestaurtinib, momelotinib, pacritinib, and upadacitinib), a cyclin-dependent kinase inhibitor, an immunogenic agent (for example, attenuated cancerous cells, tumor antigens, antigen presenting cells such as dendritic cells pulsed with tumor derived antigen or nucleic acids, a MEK inhibitor (e.g., trametinib, cobimetinib, binimetinib, and selumetinib), a GLSl inhibitor, a PAP inhibitor, an oncolytic virus, an IDO (Indoleamine-pyrrole 2,3-dioxygenase) inhibitor, a PRR (Pattern Recognition Receptors) agonist, and cells transfected with genes encoding immune stimulating cytokines such as but not limited to GM-CSF).

In some embodiments, examples of immunostimulatory cytokines include, but are not limited to, GM-CSF, G-CSF, IFNy, IFNa; IL-2 (e.g. denileukin difitox), IL-4, IL-6, IL-7, IL-10, IL-11, IL-12, IL-15, IFNA2, IL-18, and TNFa. In some embodiments, the cytokines are pegylated (e.g., pegylated IL-2, IL-10, IFNy, and IFNa).

Pattern recognition receptors (PRRs) are receptors that are expressed by cells of the immune system and that recognize a variety of molecules associated with pathogens and/or cell damage or death. PRRs are involved in both the innate immune response and the adaptive immune response. PRR agonists may be used to stimulate the immune response in a subject. There are multiple classes of PRR molecules, including toll-like receptors (TLRs), RIG-I-like receptors (RLRs), nucleotide-binding oligomerization domain (NOD)-like receptors (NLRs), C-type lectin receptors (CLRs), and Stimulator of Interferon Genes (STING) protein. The terms "TLR" and "toll-like receptor" refer to any toll-like receptor. Toll-like receptors are receptors involved in activating immune responses. TLRs recognize, for example, pathogen-associated molecular patterns (PAMPs) expressed in microbes, as well as endogenous damage-associated molecular patterns (DAMPs), which are released from dead or dying cells.

Molecules that activate TLRs (and thereby activate immune responses) are referred to herein as "TLR agonists." TLR agonists can include, for example, small molecules (e.g. organic molecule having a molecular weight under about 1000 Daltons), as well as large molecules (e.g. oligonucleotides and proteins). Some TLR agonists are specific for a single type of TLR (e.g. TLR3 or TLR9), while some TLR agonists activate two or more types of TLR (e.g. both TLR7 and TLRS).

Examples of TLR agonists provided herein include agonists of TLR2, TLR3, TLR4, TLR5, TLR6, TLR7, TLRS, and TLR9.

Examples of small molecule TLR agonists include those disclosed in, for example, U.S. Pat. Nos. 4,689,338; 4,929, 624; 5,266,575; 5,268,376; 5,346,905; 5,352,784; 5,389, 640; 5,446,153; 5,482,936; 5,756,747; 6,110,929; 6,194, 425; 6,331,539; 6,376,669; 6,451,810; 6,525,064; 6,541, 485; 6,545,016; 6,545,017; 6,573,273; 6,656,938; 6,660, 735; 6,660,747; 6,664,260; 6,664,264; 6,664,265; 6,667, 312; 6,670,372; 6,677,347; 6,677,348; 6,677,349; 6,683, 088; 6,756,382; 6,797,718; 6,818,650; and 7,7091, 214; U.S. Patent Publication Nos. 2004/0091491, 2004/0176367, and 2006/0100229; and International Publication Nos. WO 2005/18551, WO 2005/18556, WO 2005/20999, WO 2005/032484, WO 2005/048933, WO 2005/048945, WO 2005/051317, WO 2005/051324, WO 2005/066169, WO 2005/066170, WO 2005/066172, WO 2005/076783, WO 2005/079195, WO 2005/094531, WO 2005/123079, WO 2005/123080, WO 2006/009826, WO 2006/009832, WO 2006/026760, WO 2006/028451, WO 2006/028545, WO 2006/028962, WO 2006/029115, WO 2006/038923, WO 2006/065280, WO 2006/074003, WO 2006/083440, WO 2006/086449, WO 2006/091394, WO 2006/086633, WO 2006/086634, WO 2006/091567, WO 2006/091568, WO 2006/091647, WO 2006/093514, and WO 2006/098852.

Additional examples of small molecule TLR agonists include certain purine derivatives (such as those described in U.S. Pat. Nos. 6,376,501, and 6,028,076), certain imidazoquinoline amide derivatives (such as those described in U.S. Pat. No. 6,069,149), certain imidazopyridine derivatives (such as those described in U.S. Pat. No. 6,518,265), certain benzimidazole derivatives (such as those described in U.S. Pat. No. 6,387,938), certain derivatives of a 4-aminopyrimidine fused to a five membered nitrogen containing heterocyclic ring (such as adenine derivatives described in U.S. Pat. Nos. 6,376,501; 6,028,076 and 6,329, 381; and in WO 02/08905), and certain 3-.beta.-D-ribofuranosylthiazolo[4, 5-d]pyrimidine derivatives (such as those described in U.S. Publication No. 2003/0199461), and certain small molecule immuno-potentiator compounds such as those described, for example, in U.S. Patent Publication No. 2005/0136065.

Examples of large molecule TLR agonists include TLR agonist oligonucleotide sequences. Some TLR agonist oligonucleotide sequences contain cytosine-guanine dinucleotides (CpG) and are described, for example, in U.S. Pat. Nos. 6,194,388; 6,207,646; 6,239,116; 6,339,068; and 6,406,705. Some CpG-containing oligonucleotides can include synthetic immunomodulatory structural motifs such as those described, for example, in U.S. Pat. Nos. 6,426,334 and 6,476,000. Other TLR agonist nucleotide sequences lack CpG sequences and are described, for example, in International Patent Publication No. WO 00/75304. Still other TLR agonist nucleotide sequences include guanosineand uridine-rich single-stranded RNA (ssRNA) such as those described, for example, in Heil et ah, Science, vol. 303, pp. 1526-1529 Mar. 5, 2004. Other TLR agonists include biological molecules such as aminoalkyl glucosaminide phosphates (AGPs) and are described, for example, in U.S. Pat. Nos. 6,113,918; 6,303,347; 6,525,028; and 6,649,172.

TLR agonists also include inactivated pathogens or fractions thereof, which may activate multiple different types of TLR receptor. Examples of pathogen-derived TLR agonists include BCG, *Mycobacterium obuense* extract, Talimogene laherparepvec (T-Vec) (derived from HSV-1), and Pexa-Vec (derived from vaccina virus). In some embodiments, a TLR agonist may be an agonist antibody that binds specifically to the TLR.

In some embodiments, the biotherapeutic agent is an antibody, including but not limited to, an anti-CTLA-4 antibody, an anti-CD3 antibody, an anti-CD4 antibody, an anti-CD8 antibody, an anti-4-1BB antibody, an anti-PD-1 antibody, an anti-PD-L1 antibody, an anti-TIM3 antibody, an anti-LAG3 antibody, an anti-TIGIT antibody, an anti-OX40 antibody, an anti-IL-7Ralpha (CD127) antibody, an anti-IL-8 antibody, an anti-IL-15 antibody, an anti-HVEM antibody, an anti-BTLA antibody, an anti-CD40 antibody, an anti-CD40L antibody, anti-CD47 antibody, an anti-CSFIR antibody, an anti-CSFl antibody, an anti-IL-7R antibody, an anti-MARCO antibody, an anti-CXCR4 antibodies, an anti-VEGF antibody, an anti-VEGFR1 antibody, an anti-VEGFR2 antibody, an anti-TNFR1 antibody, an antiTNFR2 antibody, an anti-CD3 bispecific antibody, an anti-CD19 antibody, an anti-CD20, an anti-Her2 antibody, an anti-EGFR antibody, an anti-ICOS antibody, an anti-CD22 antibody, an anti-CD52 antibody, an anti-CCR4 antibody, an anti-CCRS antibody, an anti-CD200R antibody, an anti-VISG4 antibody, an anti-CCR2 antibody, an anti-LILRb2 antibody, an anti-CXCR4 antibody, an anti-CD206 antibody, an anti-CD163 antibody, an anti-KLRGl antibody, an anti-FLT3 antibody, an anti-B7-H4 antibody, an anti-B7-H3 antibody, an KLRG1 antibody, a BTNIAl antibody, a BCMA antibody, a CLEC9A antibody, a LILRB4 antibody, or an anti-GITR antibody.

In some embodiments, an IL-21 variant or an IL-21 fusion protein is used in combination with an immunocytokine. In some embodiments, the immunocytokine includes an antibody, or fragment thereof, conjugated or fused to a cytokine (e.g., fusion protein). In some embodiments, the antibody, or fragment thereof, binds to the Extra Domain-A (EDA) isoform of fibronectin (e.g., anti-EDA antibody). Accordingly, in some embodiments, an IL-21 variant or an IL-21 fusion protein is used in conjunction with, for example, an anti-PD-LI antagonist antibody; an anti-PD-I antagonist antibody such as for example, nivolumab (OPDIVO®), pembrolizumab (KEYTRUDA®), mAb7 (e.g., as described in US Pub. No. US20160159905, hereby incorporated by reference), and pidilizumab; an anti-CTLA-4 antagonist antibody such as for example ipilimumab (YERVOY®); an anti-LAG-3 antagonist antibody such as BMS-986016 and IMP70i; an anti-TIM-3 antagonist antibody; an anti-B7-H3 antagonist antibody such as for example MGA271; an-anti-VISTA antagonist antibody; an anti-TIGIT antagonist antibody; an anti-CD28 antagonist antibody; an anti-CD8 antibody; an anti-CD86 antibody; an anti-B7-H4 antagonist antibody; an anti-ICOS agonist antibody; an anti-CD28 agonist antibody; an innate immune response modulator (e.g., TLRs, KIR, NKG2A), and an IDO inhibitor.

In some embodiments, an IL-21 variant or an IL-21 fusion protein is used in conjunction with a 4-18B (CD137) agonist such as, for example, PF-05082566 or urelumab (BMS-663513). In some embodiments, an IL-21 variant or an IL-21 fusion protein is used in conjunction with an OX40 agonist such as, for example, an anti-OX-40 agonist antibody. In some embodiments, an IL-21 variant or an IL-21 fusion protein is used in conjunction with a GITR agonist such as, for example, TRX518. In some embodiments, an IL-21 variant or an IL-21 fusion protein is used in conjunction with an IDO inhibitor. In some embodiments, an IL-21 variant or an IL-21 fusion protein is used in conjunction with a cytokine therapy such as, for example without limitation, (pegylated or non-pegylated) IL-2, IL-10, IL-12, IL-7, IL-15, IL-21, IL-33, CSF-1, MCSF-1, etc.

In some embodiments, other examples of the antibody for the combined use with the IL-21 variant or the IL-21 fusion protein of the present invention can be directed to, 5T4; A33; alpha-folate receptor 1 (e.g., mirvetuximab soravtansine); Alk-1; CA-125 (e.g., abagovomab); Carboanhydrase IX; CCR2; CCR4 (e.g., mogamulizumab); CCR5 (e.g., Ieronlimab); CCR8; CD3 [e.g. blinatumomab (CD3/CD19 bispecific), PF-06671008 (CD3/P-cadherin bispecific), PF-06863135 (CD3/BCMA bispecific), CD25; CD28; CD30 (e.g., brentuximab vedotin); CD33 (e.g. gemtuzumab ozogamicin); CD38 (e.g., daratumumab, isatuximab), CD44v6; CD63; CD79 (e.g., polatuzumab vedotin); CD80; CD123; CD276/B7-H3 (e.g., omburtamab); CDH17; CEA; ClhCG; desmoglein 4; DLL3 (e.g., rovalpituzumab tesirine); DLL4; E-cadherin; EDA; EDB; EFNA4; EGFR (e.g., cetuximab, depatuxizumab mafodotin, necitumumab, panitumumab); EGFRvIII; Endosialin; EpCAM (e.g., oportuzumab monatox); FAP; Fetal Acetylcholine Receptor; FLT3 (e.g. see WO2018/220584); GD2 (e.g., dinutuximab, 3F8); GD3; GloboH; GMl; GM2; HER2/neu [e.g., margetuximab, pertuzumab, trastuzumab; ado-trastuzumab emtansine, trastuzumab duocarmazine, PF-06804103 (see U.S. Pat. No. 8,828,401)]; HER3; HER4; ICOS; ITG-AvB6; LAG-3 (e.g., relatlimab); Lewis-Y; LG; Ly-6; M-CSF [e.g. PD-0360324 (see U.S. Pat. No. 7,326,414)]; MCSP; mesothelin; MUCl; MUC2; MUC3; MUC4; MUCSAC; MUCSB; MUC7; MUC16; Notchl; Notch3; Nectin-4 (e.g. enfortumab vedotin); P-Cadherein [e.g. PF-06671008 (see WO2016/001810)]; PCDHB2; PDGFRA (e.g. olaratumab); Plasma Cell Antigen; PolySA; PSCA; PSMA; PTK7 [e.g. PF-06647020 (see, U.S. Pat. No. 9,409,995)]; Rorl; SAS; SCRx6; SLAMF7 (e.g. elotuzumab); SHH; SIRPa (e.g., ED9, Effi-DEM); STEAP; TGF-beta; TIGIT; TMPRSS3; TNF-alpha precursor; TROP-2 (e.g., sacituzumab govitecan); TSPAN8; and Wue-1. Examples of chemotherapeutic agents include alkylating agents such as thiotepa and cyclosphosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethylenethiophosphoramide and trimethylolomelamine; acetogenins (especially bullatacin and bullatacinone); a camptothecin (including the synthetic analogue topotecan); bryostatin; callystatin; CC-1065 (including its adozelesin, carzelesin and bizelesin synthetic analogues); cryptophycins (particularly cryptophycin 1 and cryptophycin 8); dolastatin; duocarmycin (including the synthetic analogues, KW-2189 and CBI-TMI); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, ranimustine; antibiotics such as the enediyne antibiotics (e.g., calicheamicin, especially calicheamicin gammall and calicheamicin phill, see, e.g., Agnew, Chem. Intl. Ed. Engl., 33:183-186 (1994); dynemicin, including dynemicin A; bisphosphonates, such as clodronate; an esperamicin; as well as neocarzinostatin chromophore and related chromoprotein enediyne antibiotic chromomophores), aclacinomysins, actinomycin, authramycin, azaserine, bleomycins, cactinomycin, carabicin, caminomycin, carzinophilin, chromomycins, dactinomycin, daunorubicin, detorubicin, 6-diazo-5-oxo-L-norleucine, doxorubicin (including morpholino-doxorubicin, cyanomorpholino-doxorubicin, 2-pyrrolino-doxorubicin and deoxydoxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elformithine; elliptinium acetate; an epothilone; etoglucid; gallium nitrate; hydroxyurea; lentinan; lonidamine; maytansinoids such as maytansine and ansamitocins; mitoguazone; mitoxantrone; mopidamol; nitracrine; pentostatin; phenamet; pirarubicin; losoxantrone; podophyllinic acid; 2-ethylhydrazide; procarbazine; razoxane; rhizoxin; sizofuran; spirogermanium; tenuazonic acid; triaziquone; 2, 2',2"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g. paclitaxel and doxetaxel; chlorambucil; gemcitabine; 6-thioguanine; mercaptopurine; methotrexate; platinum analogs such as carboplatin; vinblastine; platinum; etoposide (VP-16); ifosfamide; mitoxantrone; vincristine; vinorelbine; novantrone; teniposide; edatrexate; daunomycin; aminopterin; xeloda; ibandronate; CPT-11; topoisomerase inhibitor RFS 2000; difluoromethylomithine (DMFO); retinoids such as retinoic acid; capecitabine; and pharmaceutically acceptable salts, acids or derivatives of any of the above. Also included are antihormonal agents that act to regulate or inhibit hormone action on tumors such as anti-estrogens and selective estrogen receptor modulators (SERMs), including, for example, tamoxifen, raloxifene, droloxifene, 4-hydroxytamoxifen, trioxifene, keoxifene, LYll 7018, onapristone, and toremifene (Fareston); aromatase inhibitors that inhibit the enzyme aromatase, which regulates estrogen production in the adrenal glands, such as, for example, 4 (5)-imidazoles, aminoglutethimide, megestrol acetate, exemestane, formestane, fadrozole, vorozole, letrozole, and anastrozole; and antiandrogens such as flutamide, nilutamide, bicalutamide, leuprolide, fluridil, apalutamide, enzalutamide, cimetidine and goserelin; KRAS inhibitors; MCT4 inhibitors; MAT2a inhibitors; tyrosine kinase inhibitors such as sunitinib, axitinib; alk/c-Met/ROS inhibitors such as crizotinib, lorlatinib; mTOR inhibitors such as temsirolimus, gedatolisib; src/abl inhibitors such as bosutinib; cyclin-dependent kinase (CDK) inhibitors such as palbociclib, PF-06873600; erb inhibitors such as dacomitinib; PARP inhibitors such as talazoparib; SMO inhibitors such as glasdegib, PF-5274857; EGFR T790M inhibitors such as PF-06747775; EZH2 inhibitors such as PF-06821497; PRMT5 inhibitors such as PF-06939999; TGFR~rl inhibitors such as PF-06952229; and pharmaceutically acceptable salts, acids or derivatives of any of the above.

In some embodiments, an IL-21 variant or an IL-21 fusion protein is used in conjunction with one or more other therapeutic agents targeting an immune checkpoint modulator, such as, for example without limitation, an agent targeting PD-1, PDL-1, CTLA-4, LAG-3, B7-H3, B7-H4, B7-DC (PD-L2), B7-H5, B7-H6, B7-H8, B7-H2, B7-1, B7-2, ICOS, ICOS-L, TIGIT, CD2, CD47, CD80, CD86, CD48, CD58, CD226, CD155, CD112, LAIR1, 2B4, BTLA, CD160, TIMI, TIM-3, TIM4, VISTA (PD-HI), OX40, OX40L, GITRL, CD70, CD27, 4-18B, 4-BBL, DR3, TL1A, CD40, CD40L, CD30, CD30L, LIGHT, HVEM, SLAM (SLAMFl, CD150), SLAMF2 (CD48), SLAMF3 (CD229), SLAMF4 (2B4, CD244), SLAMF5 (CD84), SLAMF6 (NTB-A), SLAMCF7 (CS!), SLAMF8 (BLAME), SLAMF9 (CD2F), CD28, CEACAM1 (CD66a), CEACAM3, CEACAM4, CEACAM5, CEACAM6, CEACAM7, CEACAM8, CEACAM1-3AS CEACAM3C2, CEACAMl-15, PSGl-11, CEACAM1-4C1, CEACAM1-4S, CEACAM1-4L, IDO, TDO, CCR2, CD39-CD73-adenosine pathway (A2AR), BTKs, TIKs, CXCR2, CCR4, CCR8, CCR5, VEGF pathway, CSF-1, or an innate immune response modulator.

In some embodiments, an IL-21 variant or an IL-21 fusion protein is used in conjunction with a biotherapeutic agent and a chemotherapeutic agent. For example, this disclosure provides methods for treating cancer in a subject in need thereof that include administering to the subject an effective amount of the IL-21 variant or IL-21 fusion protein as described herein, a therapeutic antibody, and a chemotherapeutic agent (e.g., gemcitabine, methotrexate, or a platinum analog).

In some embodiments, the disclosure provides methods for treating cancer in a subject in need thereof including administering to the subject an effective amount, e.g., therapeutically effective amount, of the IL-21 variant or IL-21 fusion protein as described wherein, a therapeutic antibody (e.g., nivolumab (OPDIVO®), mAb7 (e.g., as described in US Pub. No. US20160159905, hereby incorporated by reference), or pembrolizumab (KEYTRUDA®), and a chemotherapeutic agent (e.g., gemcitabine, methotrexate, or a platinum analog). In some embodiments, methods are provided for treating cancer in a subject in need thereof comprising administering to the subject an effective amount, e.g., therapeutically effective amount, of the IL-21 variant or IL-21 fusion proteins as described wherein, an anti-CTLA-4 antagonist antibody (e.g., ipilimumab (YERVOY®)), and a chemotherapeutic agent (e.g., gemcitabine, methotrexate, or a platinum analog).

In some embodiments, the IL-21 variant or IL-21 fusion protein therapy may precede or follow the other agent treatment by intervals ranging from minutes to weeks. In embodiments where the other agents and/or a proteins or polynucleotides are administered separately, one would generally ensure that a significant period of time did not expire between each delivery, such that the agent and the composition of the present invention would still be able to exert an advantageously combined effect on the subject. In such instances, it is contemplated that one may administer both modalities within about 12-24 hours of each other, e.g., within about 6-12 hours of each other. In some situations, it may be desirable to extend the time period for administration significantly, however, where several days (2, 3, 4, 5, 6 or 7) to several weeks (1, 2, 3, 4, 5, 6, 7 or 8) lapse between the respective administrations.

In some embodiments, an IL-21 variant or an IL-21 fusion protein composition comprises a second agent selected from crizotinib, palbociclib, gemcitabine, cyclophosphamide, fluorouracil, FOLFOX, folinic acid, oxaliplatin, axitinib, sunitinib malate, tofacitinib, bevacizumab, rituximab, and trastuzumab.

In some embodiments, an IL-21 variant or IL-21 fusion protein composition is combined with a treatment regimen further comprising a traditional therapy selected from the group consisting of: surgery, radiation therapy, chemotherapy, targeted therapy, immunotherapy, hormonal therapy, angiogenesis inhibition and palliative care.

Formulations

Therapeutic formulations of the IL-21 variant or IL-21 fusion protein used in accordance with the present disclosure are prepared for storage by mixing the protein having the desired degree of purity with optional pharmaceutically acceptable carriers, excipients, or stabilizers (Remington, The Science and Practice of Pharmacy 20th Ed. Mack Publishing, 2000), e.g., in the form of lyophilized formulations or aqueous solutions. Acceptable carriers, excipients, or stabilizers are nontoxic to recipients at the dosages and concentrations employed, and may include buffers such as phosphate, citrate, and other organic acids; salts such as sodium chloride; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens, such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as TWEEN™, PLURONICS™ or polyethylene glycol (PEG).

Liposomes containing the IL-21 variant or IL-21 fusion protein are prepared by methods known in the art, such as described in Epstein, et al., Proc. Natl. Acad. Sci. USA 82:3688 (1985); Hwang, et al., Proc. Natl Acad. Sci. USA 77:4030 (1980); and U.S. Pat. Nos. 4,485,045 and 4,544,545. Liposomes with enhanced circulation time are disclosed in U.S. Pat. No. 5,013,556. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. The active ingredients may also be entrapped in microcapsules prepared, for example, by coacervation techniques or by interfacial polymerization, for example, hydroxymethylcellulose or gelatin-microcapsules and poly (methylmethacrylate) microcapsules, respectively, in colloidal drug delivery systems (for example, liposomes, albumin microspheres, microemulsions, nano-particles and nanocapsules) or in macroemulsions. Such techniques are disclosed in Remington, The Science and Practice of Pharmacy 20th Ed. Mack Publishing (2000).

Sustained-release preparations may be prepared. Suitable examples of sustained-release preparations include semipermeable matrices of solid hydrophobic polymers containing the antibody, which matrices are in the form of shaped articles, e.g. films, or microcapsules. Examples of sustained-release matrices include polyesters, hydrogels (for example, poly(2-hydroxyethyl-methacrylate), or poly(vinyl alcohol)), polylactides (U.S. Pat. No. 3,773,919), copolymers of L-glutamic acid and 7 ethyl-L-glutamate, nondegradable ethylene-vinyl acetate, degradable lactic acid glycolic acid copolymers such as the LUPRON DEPOT™ (injectable microspheres composed of lactic acid-glycolic acid copolymer and leuprolide acetate), sucrose acetate isobutyrate, and poly-D-(−)-3-hydroxybutyric acid.

The formulations to be used for in vivo administration must be sterile. This is readily accomplished by, for example, filtration through sterile filtration membranes. Therapeutic IL-21 variant or IL-21 fusion protein compositions are generally placed into a container having a sterile access port, for example, an intravenous solution bag or vial having a stopper pierceable by a hypodermic injection needle.

The compositions according to the present invention may be in unit dosage forms such as tablets, pills, capsules, powders, granules, solutions or suspensions, or suppositories, for oral, parenteral, or rectal administration, or administration by inhalation or insufflation.

For preparing solid compositions such as tablets, the principal active ingredient is mixed with a pharmaceutical carrier, e.g. conventional tableting ingredients such as corn starch, lactose, sucrose, sorbitol, talc, stearic acid, magnesium stearate, dicalcium phosphate or gums, and other pharmaceutical diluents, e.g. water, to form a solid preformulation composition containing a homogeneous mixture of a compound of the present invention, or a non-toxic pharmaceutically acceptable salt thereof. When referring to these preformulation compositions as homogeneous, it is meant that the active ingredient is dispersed evenly throughout the composition so that the composition may be readily subdivided into equally effective unit dosage forms such as tablets, pills and capsules. This solid preformulation composition is then subdivided into unit dosage forms of the type described above containing from about 0.1 to about 500 mg of the active ingredient of the present invention. The tablets or pills of the novel composition can be coated or otherwise compounded to provide a dosage form affording the advantage of prolonged action. For example, the tablet or pill can comprise an inner dosage and an outer dosage component, the latter being in the form of an envelope over the former. The two components can be separated by an enteric layer that serves to resist disintegration in the stomach and permits the inner component to pass intact into the duodenum or to be delayed in release. A variety of materials can be used for such enteric layers or coatings, such materials including a number of polymeric acids and mixtures of polymeric acids with such materials as shellac, cetyl alcohol and cellulose acetate. Suitable surface-active agents include, in particular, non-ionic agents, such as polyoxyethylene sorbitans (e.g., Tween™ 20, 40, 60, 80 or 85) and other sorbitans (e.g., Span™ 20, 40, 60, 80 or 85). Compositions with a surface-active agent will conveniently include between 0.05 and 5% surface-active agent, e.g., between 0.1 and 2.5%. It will be appreciated that other ingredients may be added, for example mannitol or other pharmaceutically acceptable vehicles, if necessary.

Suitable emulsions may be prepared using commercially available fat emulsions, such as Intralipid™, Liposyn™, Infonutrol™, Lipofundin™, and Lipiphysan™. The active ingredient may be either dissolved in a pre-mixed emulsion composition or alternatively it may be dissolved in an oil (e.g. soybean oil, safflower oil, cottonseed oil, sesame oil, corn oil or almond oil) and an emulsion formed upon mixing with a phospholipid (e.g. egg phospholipids, soybean phospholipids or soybean lecithin) and water. It will be appreciated that other ingredients may be added, for example glycerol or glucose, to adjust the tonicity of the emulsion. Suitable emulsions will typically contain up to 20% oil, for example, between 5 and 20%. The fat emulsion can comprise fat droplets between 0.1 and 1.0 μm, particularly 0.1 and 0.5 μm, and have a pH in the range of 5.5 to 8.0.

The emulsion compositions can be those prepared by mixing an IL-21 variant or IL-21 fusion protein with Intralipid™ or the components thereof (soybean oil, egg phospholipids, glycerol, and water). Compositions for inhalation or insuflation include solutions and suspensions in pharmaceutically acceptable, aqueous or organic solvents, or mixtures thereof, and powders. The liquid or solid compositions may contain suitable pharmaceutically acceptable excipients as set out above. In some embodiments, the compositions are administered by the oral or nasal respiratory route for local or systemic effect. Compositions in preferably sterile pharmaceutically acceptable solvents may be nebulized by use of gases. Nebulized solutions may be breathed directly from the nebulizing device or the nebulizing device may be attached to a face mask, tent or intermittent positive pressure breathing machine. Solution, suspension, or powder compositions may be administered, preferably orally or nasally, from devices which deliver the formulation in an appropriate manner. Kits The disclosure also provides kits comprising any or all of the IL-21 variants or IL-21-fusion proteins described herein. Kits of the invention include one or more containers comprising an IL-21 variant or IL-21 fusion protein described herein and instructions for use in accordance with any of the methods of the invention described herein. Generally, these instructions comprise a description of administration of the IL-21 variant or IL-21 fusion protein for the therapeutic treatments described herein. In some embodiments, kits are provided for producing a single-dose administration unit. In certain embodiments, the kit can contain both a first container having a dried protein and a second container having an aqueous formulation. In certain embodiments, kits containing single and multi-chambered pre-filled syringes (e.g., liquid syringes and lyosyringes) are included.

The instructions relating to the use of an IL-21 variant or an IL-21 fusion protein generally include information as to dosage, dosing schedule, and route of administration for the intended treatment. The containers may be unit doses, bulk packages (e.g., multi-dose packages) or sub-unit doses. Instructions supplied in the kits of the invention are typically written instructions on a label or package insert (e.g., a paper sheet included in the kit), but machine-readable instructions (e.g., instructions carried on a magnetic or optical storage disk) are also acceptable.

The kits of this invention are in suitable packaging. Suitable packaging includes, but is not limited to, vials, bottles, jars, flexible packaging (e.g., sealed Mylar or plastic bags), and the like. Also contemplated are packages for use in combination with a specific device, such as an inhaler, nasal administration device (e.g., an atomizer) or an infusion device such as a minipump. A kit may have a sterile access port (for example the container may be an intravenous solution bag or a vial having a stopper pierceable by a hypodermic injection needle). The container may also have a sterile access port (for example the container may be an intravenous solution bag or a vial having a stopper pierceable by a hypodermic injection needle). At least one active agent in the composition is an IL-21 variant or an IL-21 fusion protein. The container may further comprise a second pharmaceutically active agent.

Kits may optionally provide additional components such as buffers and interpretive information. Normally, the kit comprises a container and a label or package insert(s) on or associated with the container.

EXAMPLES

The invention is further described in the following examples, which do not limit the scope of the invention described in the claims.

Example 1: Validating IL-21/IL-21R Interaction Network Using AlphaSeq™

Prior to measuring binding affinities of IL-21 variants using the IL-21R receptor, the wild-type IL-21 and IL-21R interactions were validated using the AlphaSeq™ assay. Various construct designs for human, cynomolgus monkey (cyno), mouse, and rat IL-21 and IL-21R were designed and constructed into AlphaSeq™ yeast strains. An AlphaSeq™ assay was performed to measure all the pairwise interactions between IL-21 and IL-21R construct designs.

AlphaSeq™ predicted affinities (log $10K_d$ nM) for the IL-21/IL-21R validation network under standard conditions are shown in FIG. 1A. Strong binding is considered below 3 (dark gray), weak binding is considered between 3 and 4.5 (medium gray), no binding is considered above 4 (lightest gray). In standard conditions, human and cyno IL-21 each bound to both human and cyno IL-21R, while mouse and rat IL-21 each bound to all four IL-21R orthologs. Only the rat IL-21/ratIL-21R showed strong binding (AlphaSeq™ Kd<3)

AlphaSeq™ predicted affinities (log $10K_d$ nM) for the IL-21/IL-21R validation network were also measured in media buffered to pH 7 (FIG. 1B). In this condition, strong binding is considered below 2 (dark gray), weak binding is considered between 2 and 3.5 (medium gray), no binding is considered above 3.5 (lightest gray). Using these definitions, at pH 7, human IL-21 bound strongly to human and cyno IL-21R and weakly to rat IL-21R. Cyno IL-21 bound strongly to human and cyno IL-21R. Mouse and rat IL-21 bound strongly to all IL-21 orthologs.

Example 2: Measuring Affinity of IL-21 Variants to IL-21R

To identify IL-21 variants with decreased affinity for human IL-21R using AlphaSeq™, a site saturation mutagenesis (SSM) library of IL-21 was constructed, such that each of the 121 amino acid residues in the displayed protein, which consists of residues 32-152 of IL-21, was mutated to every other amino acid, excluding cysteine. The variant library consisted of 2106 total variant IL-21 proteins, which was combined with 117 copies of the wild-type IL-21 sequence, such that the total library consisted of 2223 proteins. These 2223 proteins were synthesized and cloned into yeast display libraries and associated with nucleotide barcodes as described above. Each protein was displayed as a synthetic adhesion protein (SAP) fusion protein to the yeast agglutination factor Aga2 and the HA epitope tag.

To identify mouse IL-21 (mIL-21) variants with decreased affinity for mouse IL-21R (mIL-21R) using AlphaSeq™, a site saturation mutagenesis (SSM) library of mIL-21 was constructed, such that each of the amino acid residues in the displayed protein, which consists of residues 22-145 of mIL-21, was mutated to every other amino acid, excluding cysteine. The variant library consisted of 2160 total variant IL-21 proteins, which was combined with 120 copies of the wild-type IL-21 sequence, such that the total library consisted of 2280 proteins. These 2280 proteins were synthesized and cloned into yeast display libraries and associated with nucleotide barcodes as described above. Each protein was displayed as a synthetic adhesion protein (SAP) fusion protein to the yeast agglutination factor Aga2 and the HA epitope tag.

Using AlphaSeq™, affinity predictions were obtained for interactions between each of the human and mouse IL-21 SSM variants and human, cyno, mouse, and rat IL-21R. Variants of interest were those with decreased affinity (higher $K_d$ values) than the wild-type IL-21/IL-21R interaction. Because an increased dynamic range was observed for IL-21/IL-21R interaction affinity when the AlphaSeq™ assay was performed in buffered media, IL-21/IL-21R binding was measured using both standard AlphaSeq™ conditions (unbuffered media), as well as media buffered at pH 7, pH 6, and pH 5. In the AlphaSeq™ assay, if a given variant has apparently decreased affinity, this could be due to true detuning—i.e., the affinity between IL-21 and IL-21R is actually decreased—or from a decrease in expression or stability of the particular IL-21 variant relative to wild-type. For therapeutic applications, the former is preferred. Thus, a parallel assay was performed to measure the surface expression of each displayed IL-21 variant.

To measure surface expression, the library of variants was labeled with a FITC-conjugated anti-HA antibody. Labeled cells were then sorted by FACS into one of three bins-low (bin 1), medium (bin 2), or high (bin 3)—based on fluorescence intensity. Cells expressing higher levels of IL-21 were expected to be enriched in the high bin and vice versa for those cells expressing lower levels of IL-21. DNA was extracted from each of the three sorted samples and subjected to deep Illumina™ sequencing at the barcode locus. The number of reads aligning to each barcode was counted for each bin and normalized to the total number of reads in that bin and to the number of reads in the unsorted library, which results in an enrichment score for each barcode in each bin.

Figure 2B:
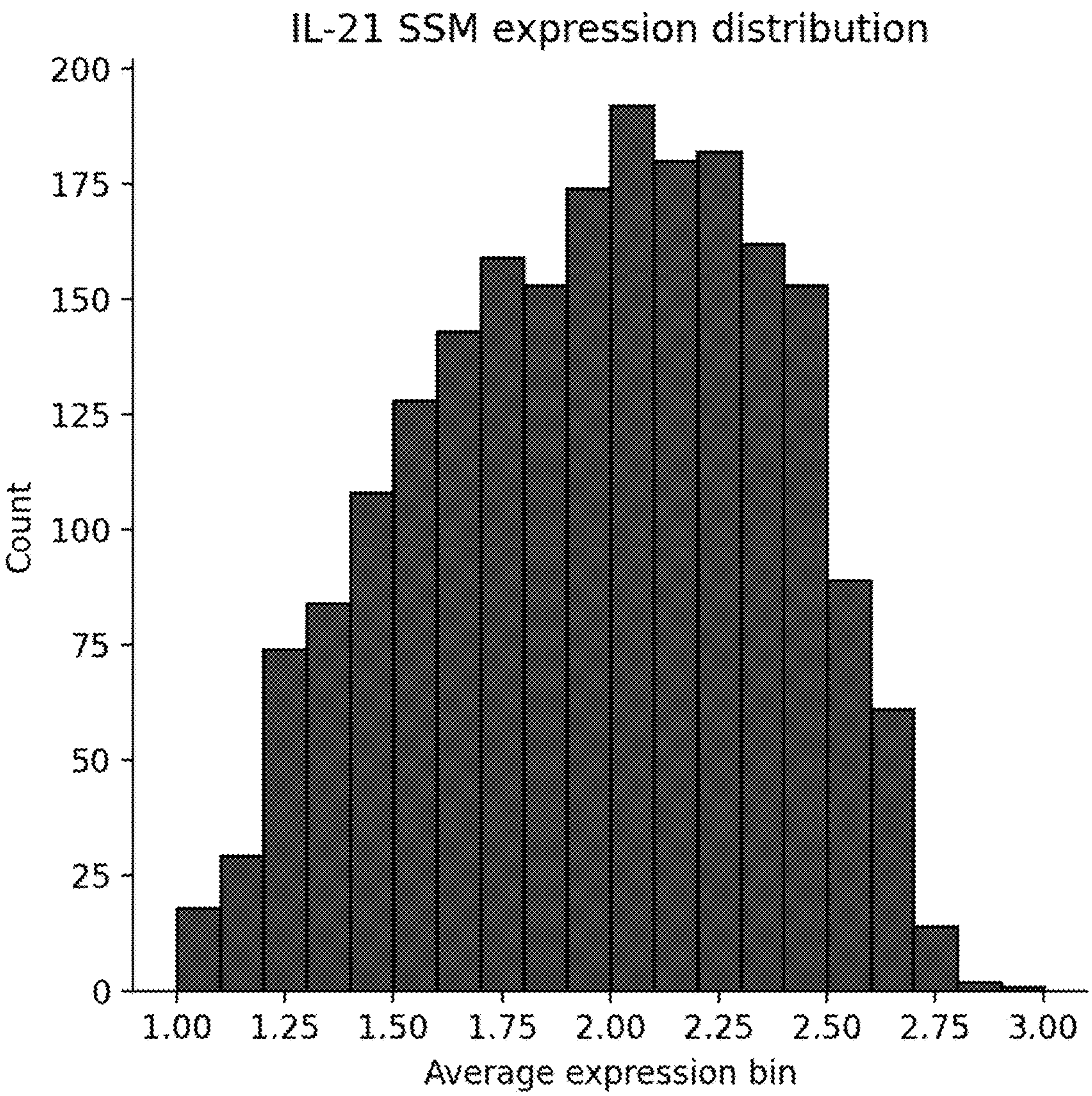
FIG. 2B is a histogram of expression values for site-saturation mutagenesis (SSM) variants of human IL-21. A value of 3 is the maximum possible expression in this assay and a value of 1 is the minimum possible expression.
Figure 3A:
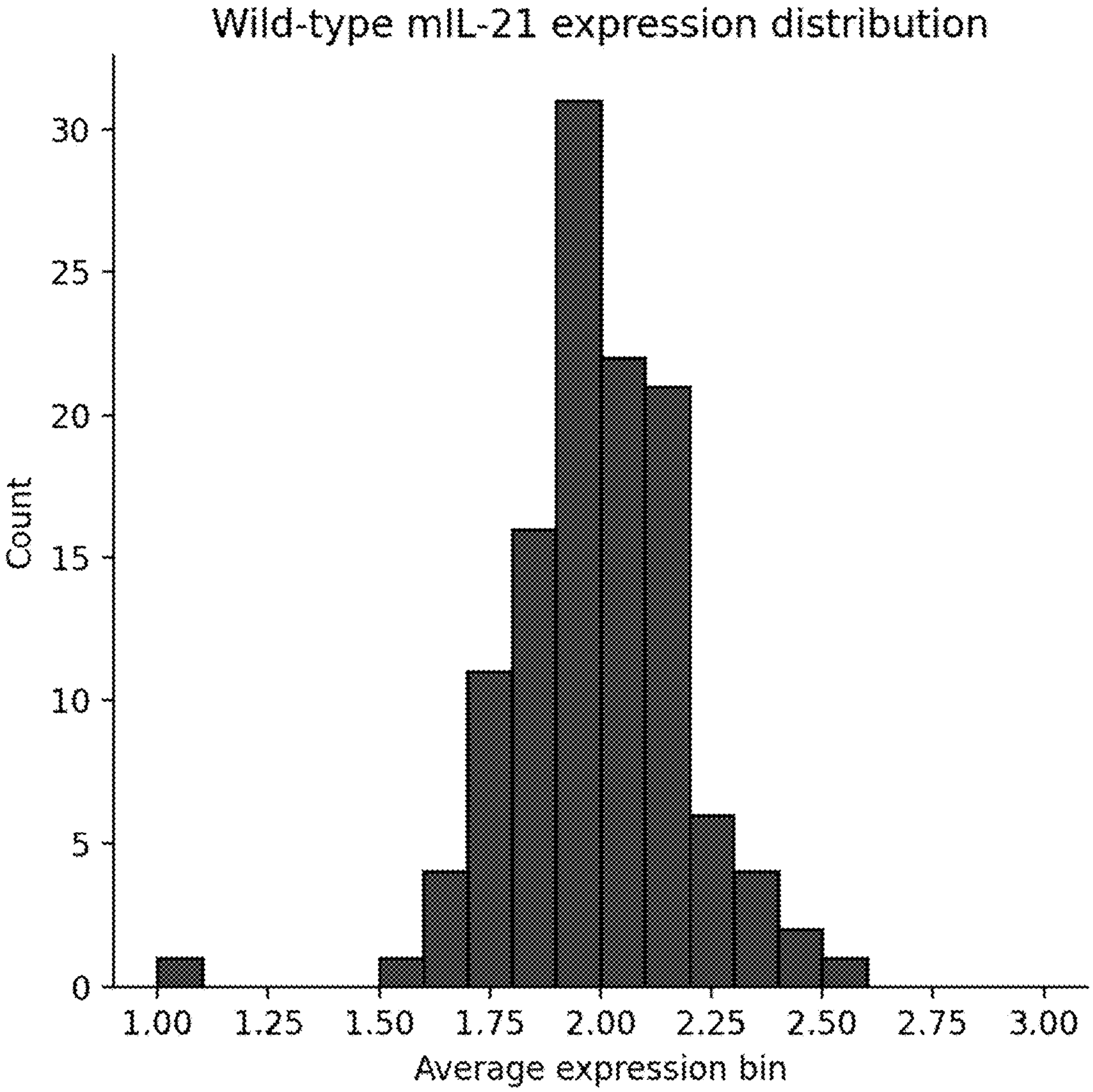
FIG. 3A is a histogram of expression values for wild-type replicates of mouse IL-21. A value of 3 is the maximum possible expression in this assay and a value of 1 is the minimum possible expression.
Figure 3B:
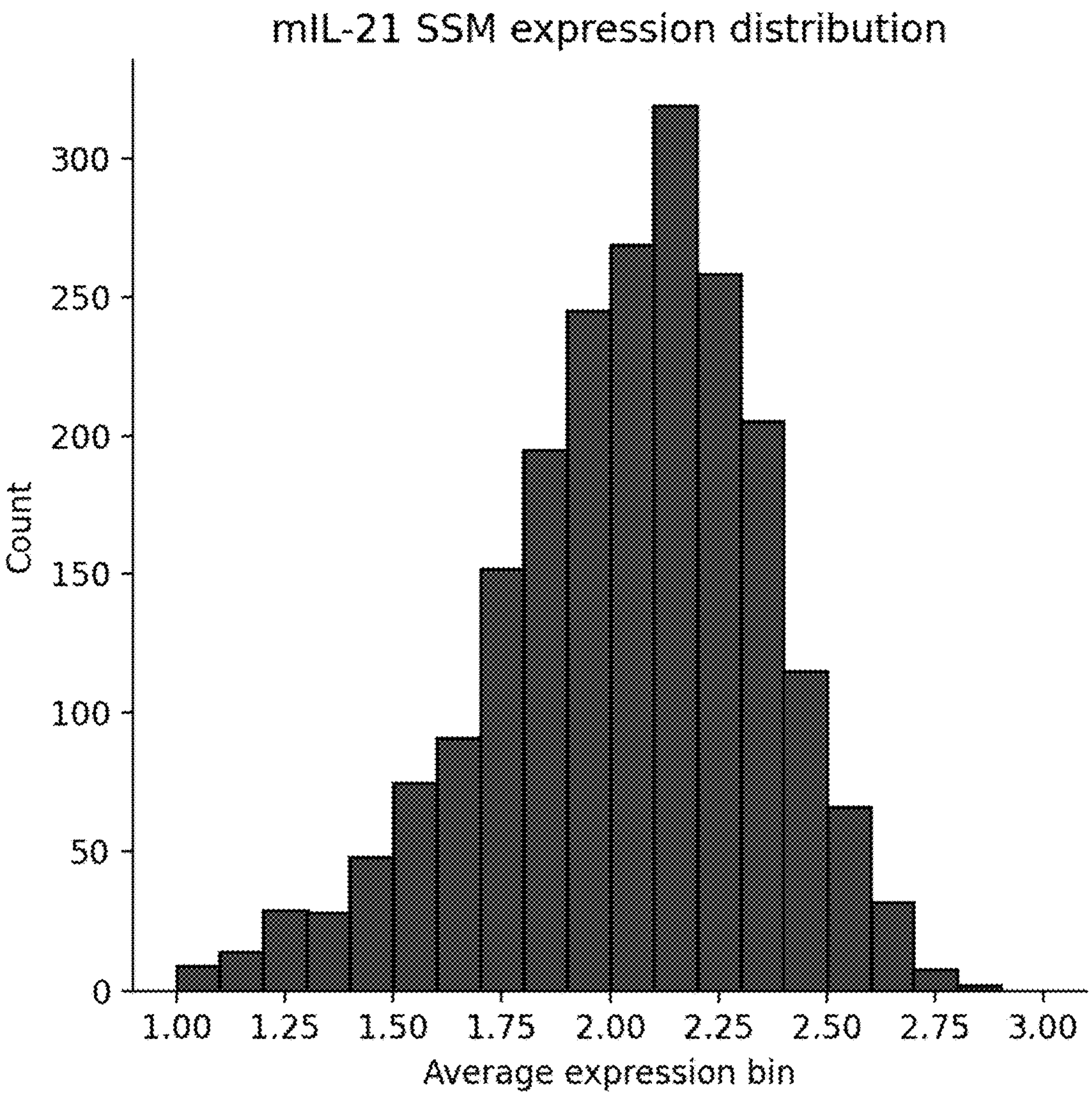
FIG. 3B is a histogram of expression values for site-saturation mutagenesis (SSM) variants of mouse IL-21. A value of 3 is the maximum possible expression in this assay and a value of 1 is the minimum possible expression.

The enrichment scores for the 3 bins were combined into an expression value using the formula (1*bin1_enrichment+2*bin2_enrichment+3*bin3_enrichment)/(bin1_enrichment+bin2_enrichment+bin3_enrichment). This expression metric is termed the average expression bin for each barcode and returns a value between 1 and 3. Very highly expressing variants (i.e., those with most barcode reads in bin 3) have an average expression bin value approaching 3, while very lowly expressing variants (i.e., those with most reads in bin 1) have a value approaching 1. The average expression bin values for the various barcodes associated with each single IL-21 variant were combined as a weighted average based on frequency in the unsorted population to obtain a value for each protein. The distribution of average expression bin values for the wild-type copies of human IL-21 are shown in FIG. 2A and the values for the members of the human IL-21 SSM library are shown in FIG. 2B. The distribution of average expression bin values for the wild-type copies of mouse IL-21 are shown in FIG. 3A and the values for the members of the mouse IL-21 SSM library are shown in FIG. 3B.

Figure 4A:
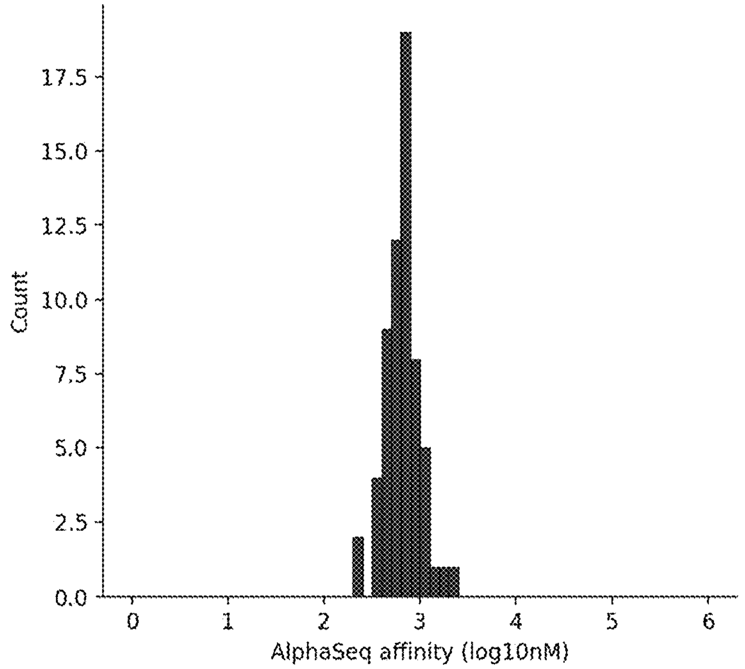
FIG. 4A is a histogram of AlphaSeq™ affinity values for the replicates of wild-type human IL-21 binding to human IL-21R in unbuffered media.
Figure 4B:
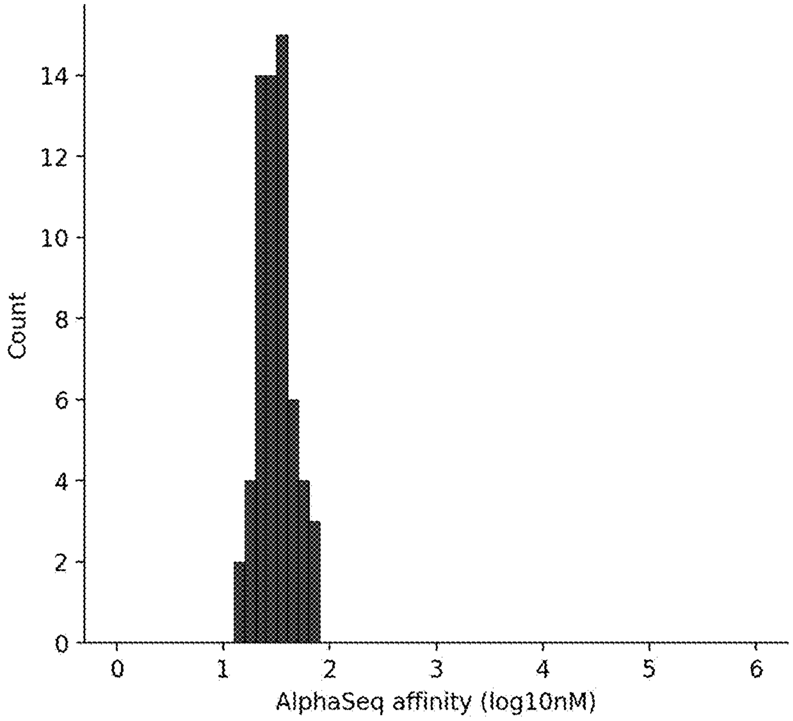
FIG. 4B is a histogram of AlphaSeq™ affinity values for the replicates of wild-type human IL-21 binding to human IL-21R in pH 5 media.
Figure 4C:
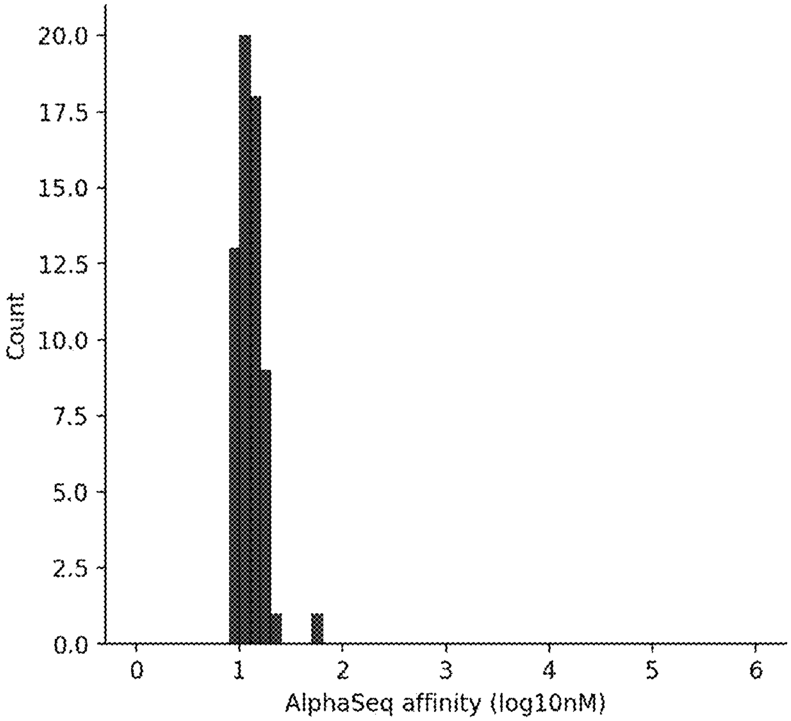
FIG. 4C is a histogram of AlphaSeq™ affinity values for the replicates of wild-type human IL-21 binding to human IL-21R in pH 6 media.
Figure 4D:
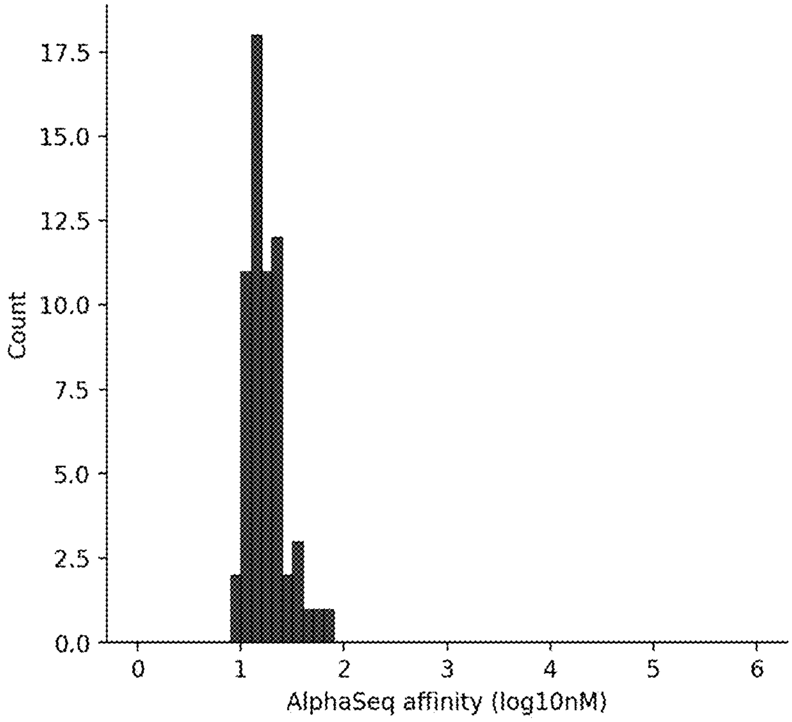
FIG. 4D is a histogram of AlphaSeq™ affinity values for the replicates of wild-type human IL-21 binding to human IL-21R in pH 7 media.
Figure 5A:
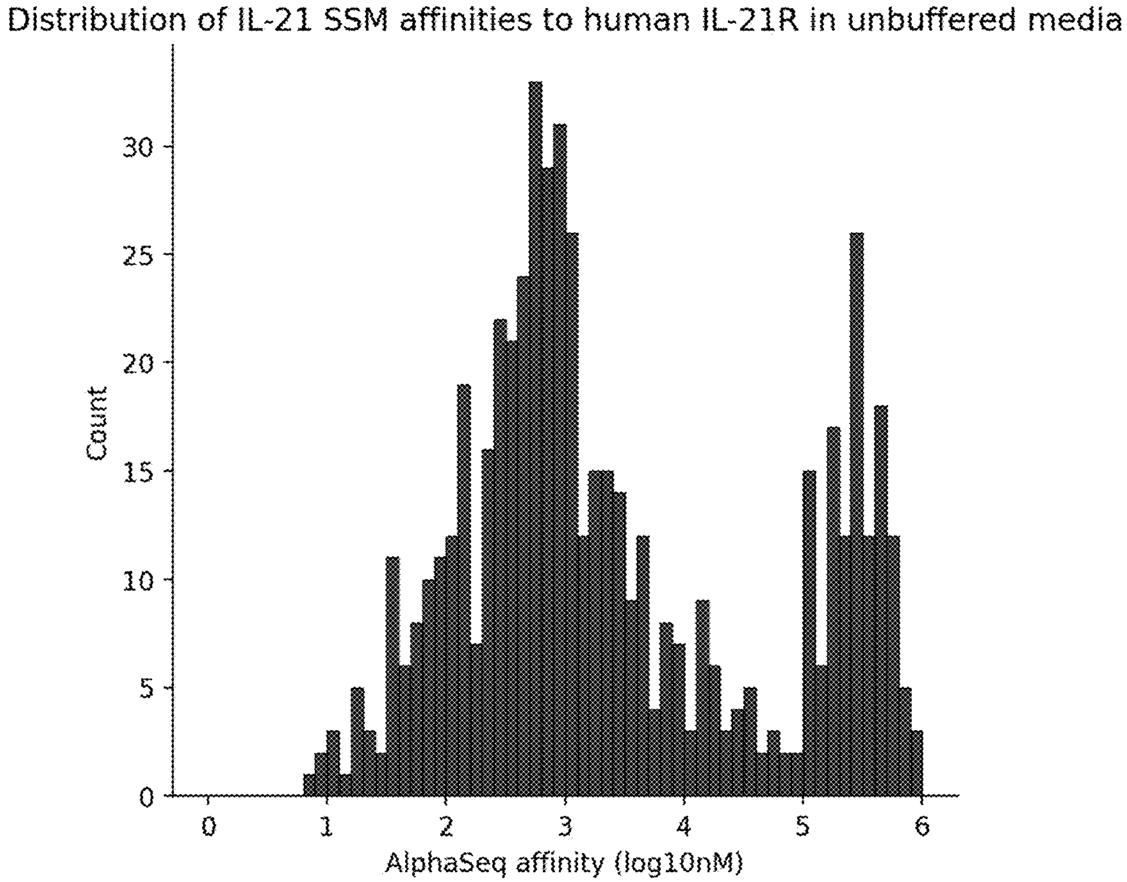
FIG. 5A is a histogram of AlphaSeq™ affinity values for the full human IL-21 SSM binding to human IL-21R in unbuffered media.
Figure 5B:
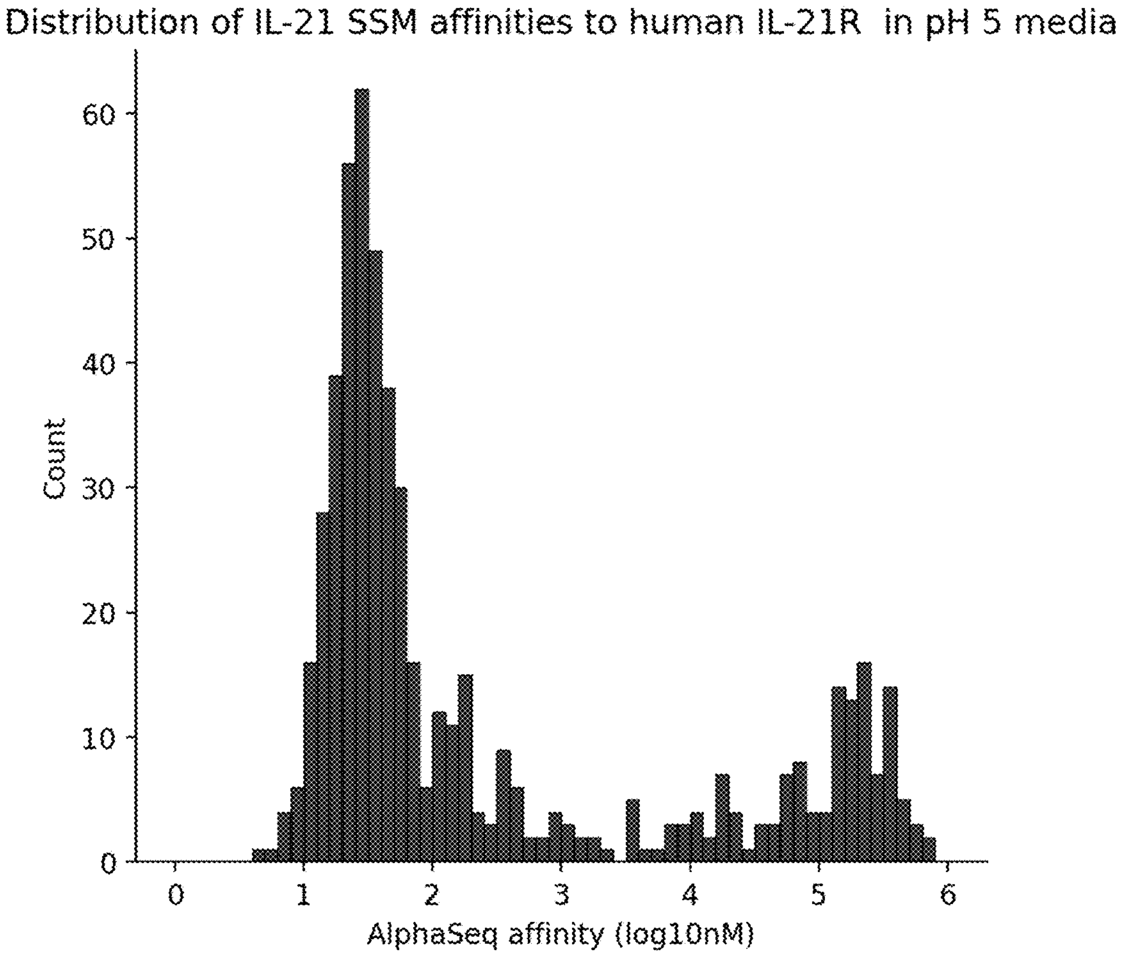
FIG. 5B is a histogram of AlphaSeq™ affinity values for the full human IL-21 SSM binding to human IL-21R in pH 5 media.
Figure 5C:
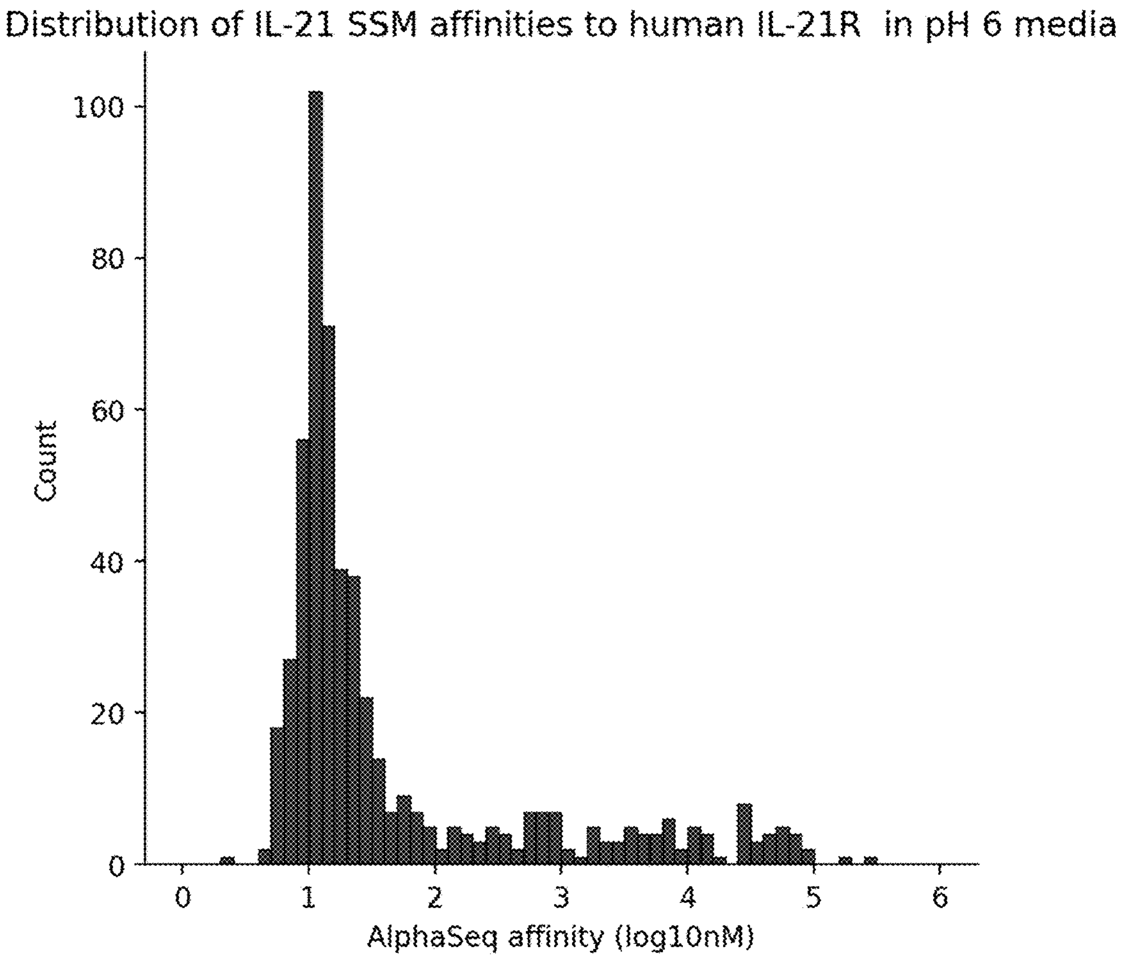
FIG. 5C is a histogram of AlphaSeq™ affinity values for the full human IL-21 SSM binding to human IL-21R in pH 6 media.
Figure 5D:
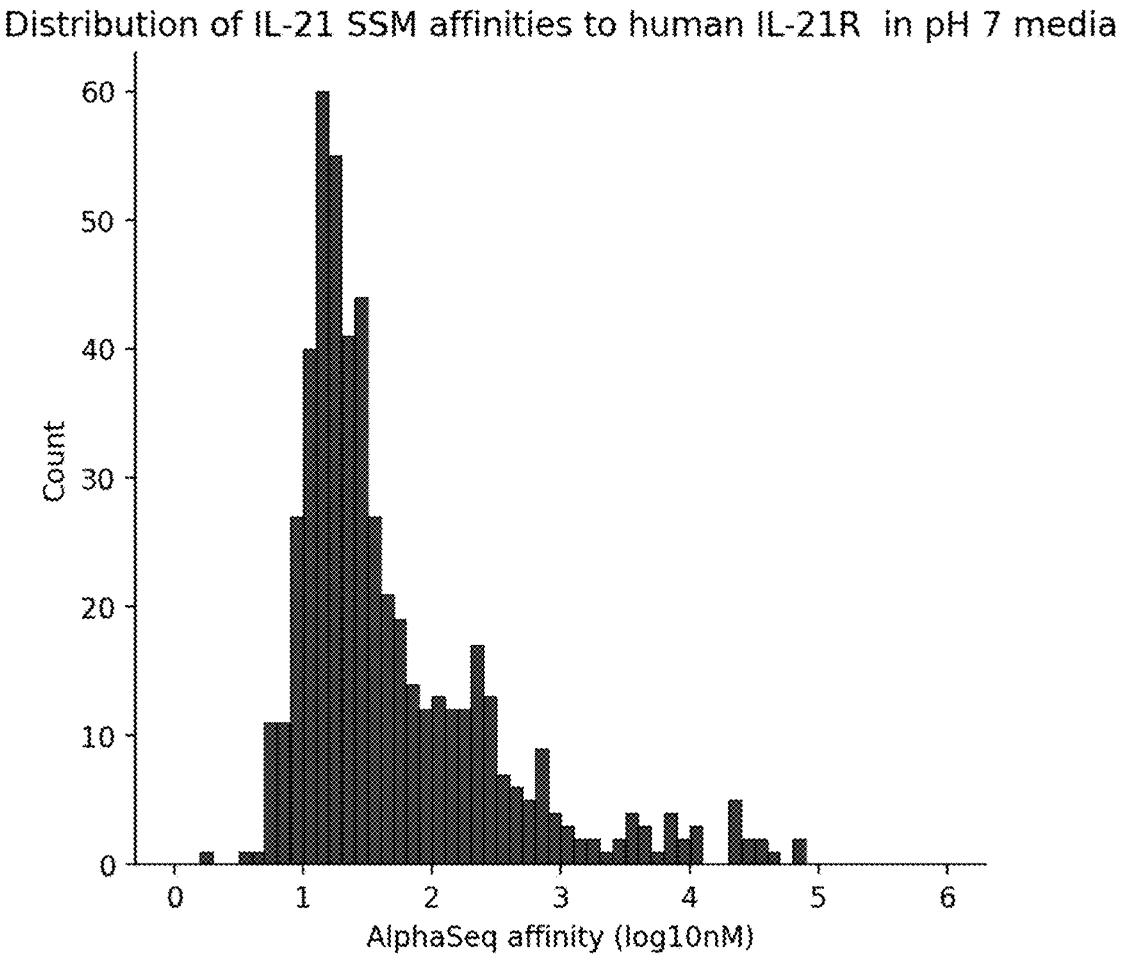
FIG. 5D is a histogram of AlphaSeq™ affinity values for the full human IL-21 SSM binding to human IL-21R in pH 7 media.

From these datasets, for each human IL-21 variant, an affinity for human IL-21R was obtained and an expression score was measured. After filtering AlphaSeq™ results to include only variants with average expression bin >2.25, the average affinity between the 117 wild-type IL-21 replicates and human IL-21R was found to be 646 nM in unbuffered media (log 10 nM=2.8 in FIG. 4A), 30 nM in pH 5 media (log 10 nM=1.5 in FIG. 4B), 13 nM in pH 6 media (log 10 nM=1.1 in FIG. 4C), and 18 nM in pH 7 media (log 10 nM=1.2 in FIG. 4D). The distribution of IL-21 SSM mutant affinities to human IL-21R are shown in unbuffered media (FIG. 5A), pH 5 media (FIG. 5B), pH 6 media (FIG. 5C), and pH 7 media (FIG. 5D). In contrast to the wild-type affinity values, which show a tight distribution, the IL-21 variants show a wide range of affinities, spanning from wild-type levels of binding to background-level binding. The minimal criteria for considering a variant detuned were as follows: expression >2.25 on a scale where no expression=1.0 and maximum expression=3.0; affinity measurements representing a half-log reduction in binding affinity from wild-type human IL-21 in at least one of the tested media conditions. This value varied depending on the media condition used:

Unbuffered detuned variant cutoff: 2.0 μM (log 10 nM=3.3)

pH 7:56 nM (log 10 nM=1.7)

pH 6:41 nM (log 10 nM=1.6)

pH 5:94 nM (log 10 nM=2.0)

These criteria lead to a total of 273 IL-21 variants (Table 1), of which 194 retain binding affinity stronger than the approximate assay limit of detection (limit of detection defined as 2 standard deviations stronger affinity than the mean of negative control interactions).

Figure 6A:
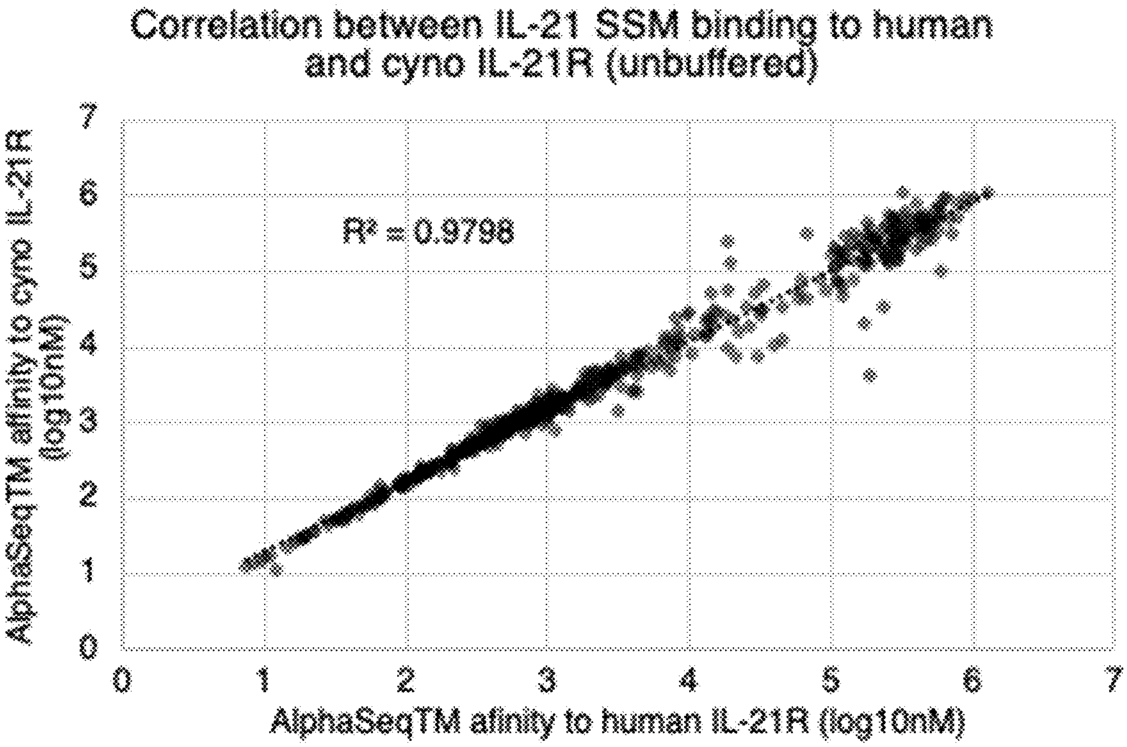
FIG. 6A is a scatter plot showing the relationship between AlphaSeq™ affinity to human IL-21R (x-axis) and AlphaSeq™ affinity to cynomolgus monkey IL-21R (y-axis) for each variant in the IL-21 SSM library, measured in unbuffered media.
Figure 6B:
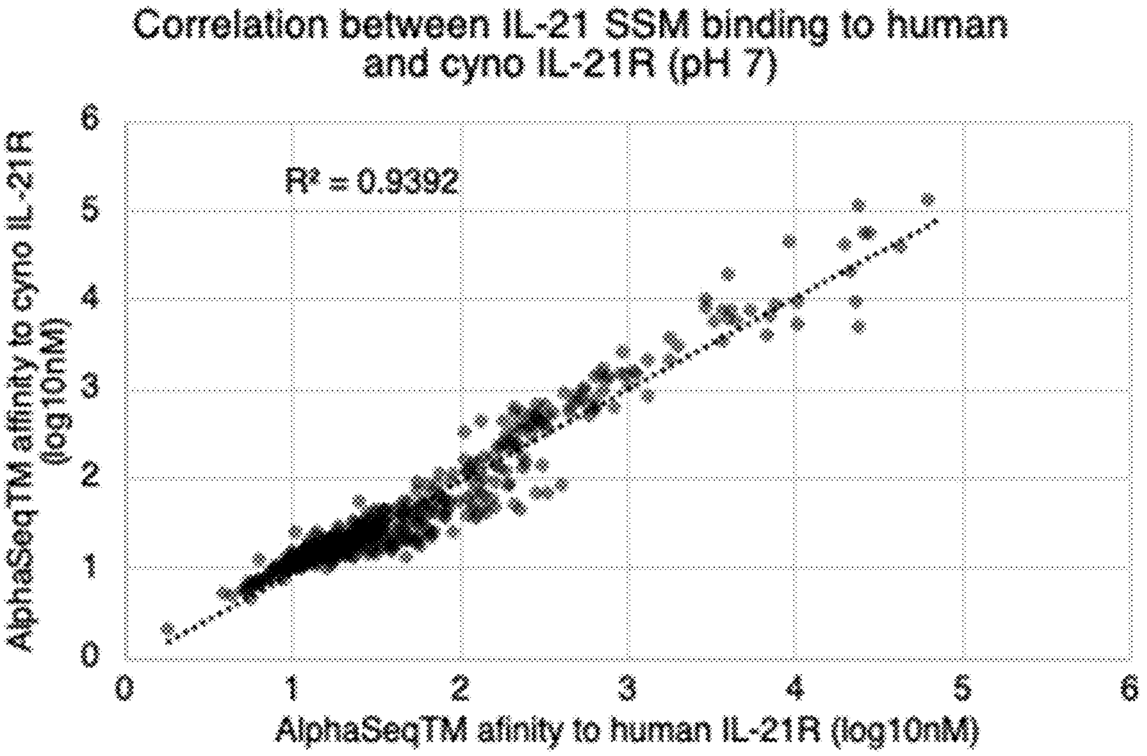
FIG. 6B is a scatter plot showing the relationship between AlphaSeq™ affinity to human IL-21R (x-axis) and AlphaSeq™ affinity to cynomolgus monkey IL-21R (y-axis) for each variant in the IL-21 SSM library, measured in pH 7 media.

The AlphaSeq™ platform allowed simultaneous measurement of IL-21 variant affinities to cyno, rat, and mouse orthologs of IL-21R. Human IL-21 variants showed highly correlated degrees of detuning to human and cyno IL-21R in both unbuffered media (FIG. 6A) and pH 7 media (FIG. 6B).

Figure 7A:
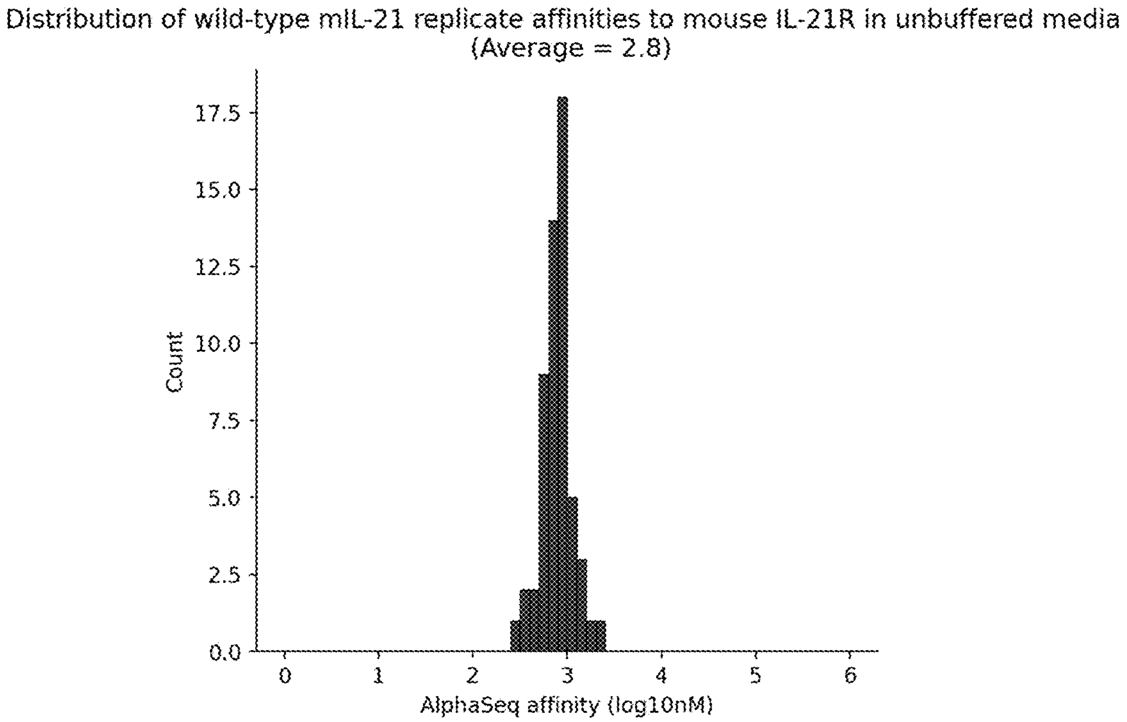
FIG. 7A is a histogram of AlphaSeq™ affinity values for the replicates of wild-type mouse IL-21 binding to mouse IL-21R in unbuffered media.
Figure 7B:
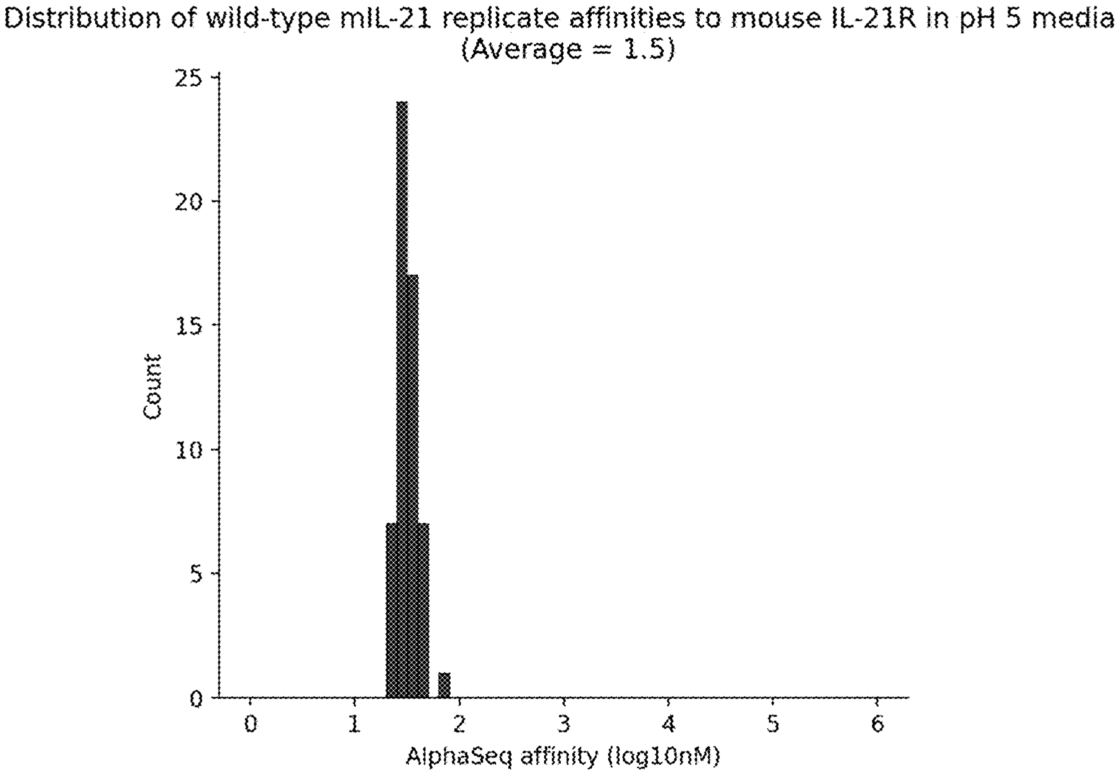
FIG. 7B is a histogram of AlphaSeq™ affinity values for the replicates of wild-type mouse IL-21 binding to mouse IL-21R in pH 5 media.
Figure 7C:
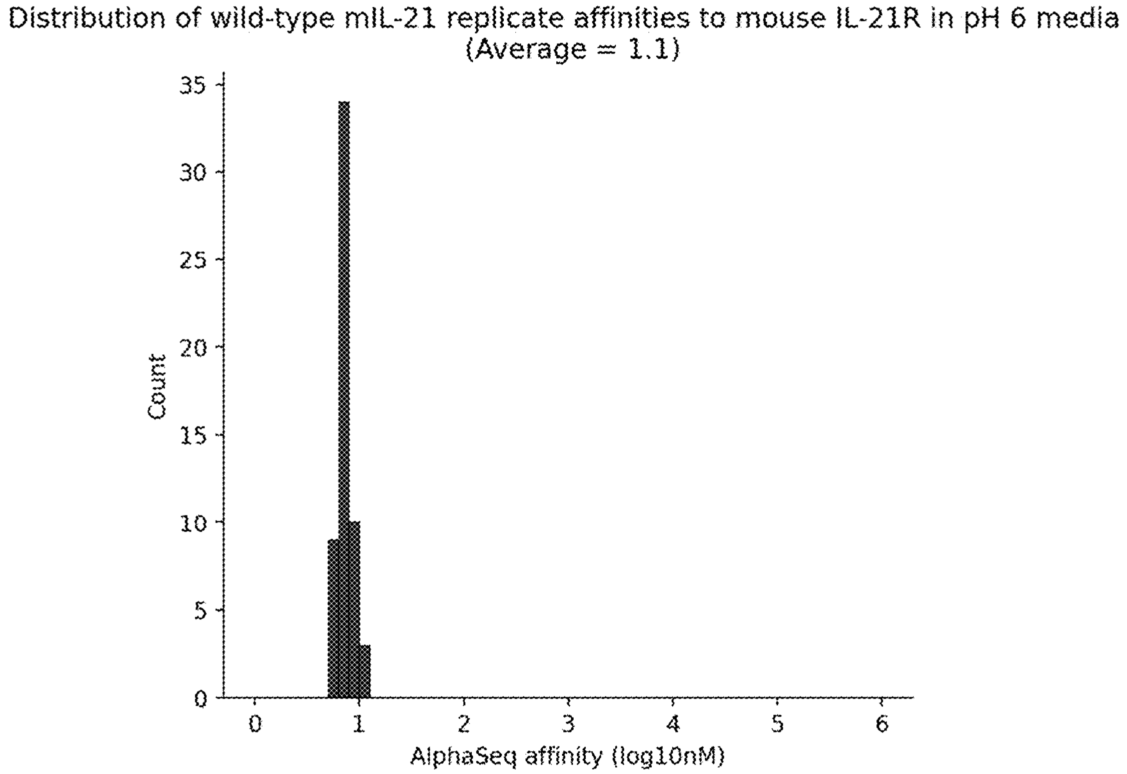
FIG. 7C is a histogram of AlphaSeq™ affinity values for the replicates of wild-type mouse IL-21 binding to mouse IL-21R in pH 6 media.
Figure 7D:
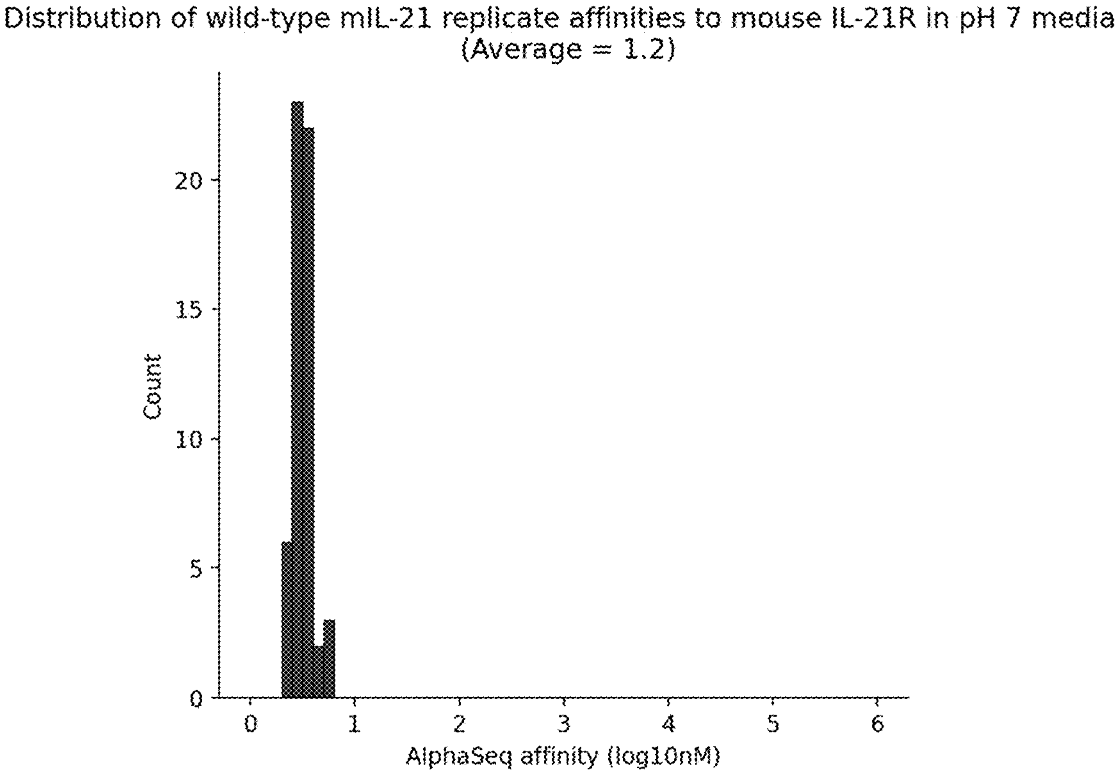
FIG. 7D is a histogram of AlphaSeq™ affinity values for the replicates of wild-type mouse IL-21 binding to mouse IL-21R in pH 7 media.
Figure 8A:
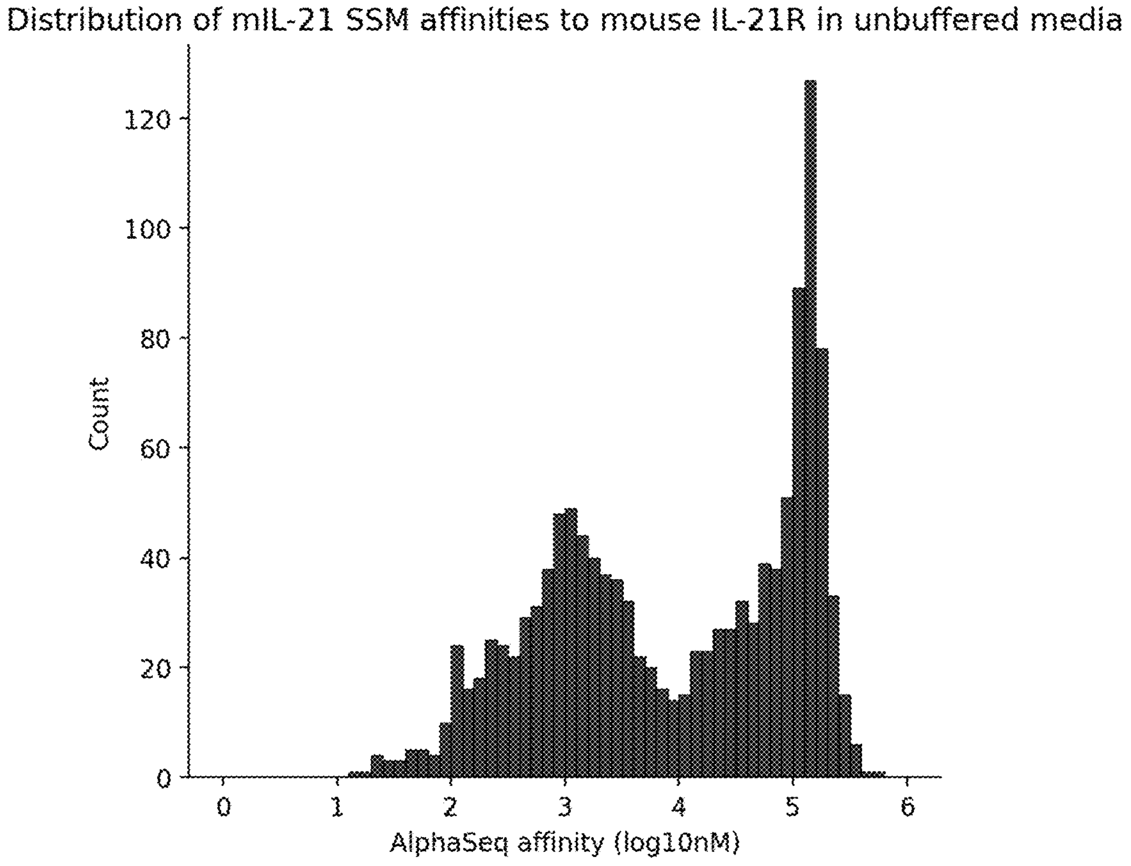
FIG. 8A is a histogram of AlphaSeq™ affinity values for the full mouse IL-21 SSM binding to mouse IL-21R in unbuffered media.
Figure 8B:
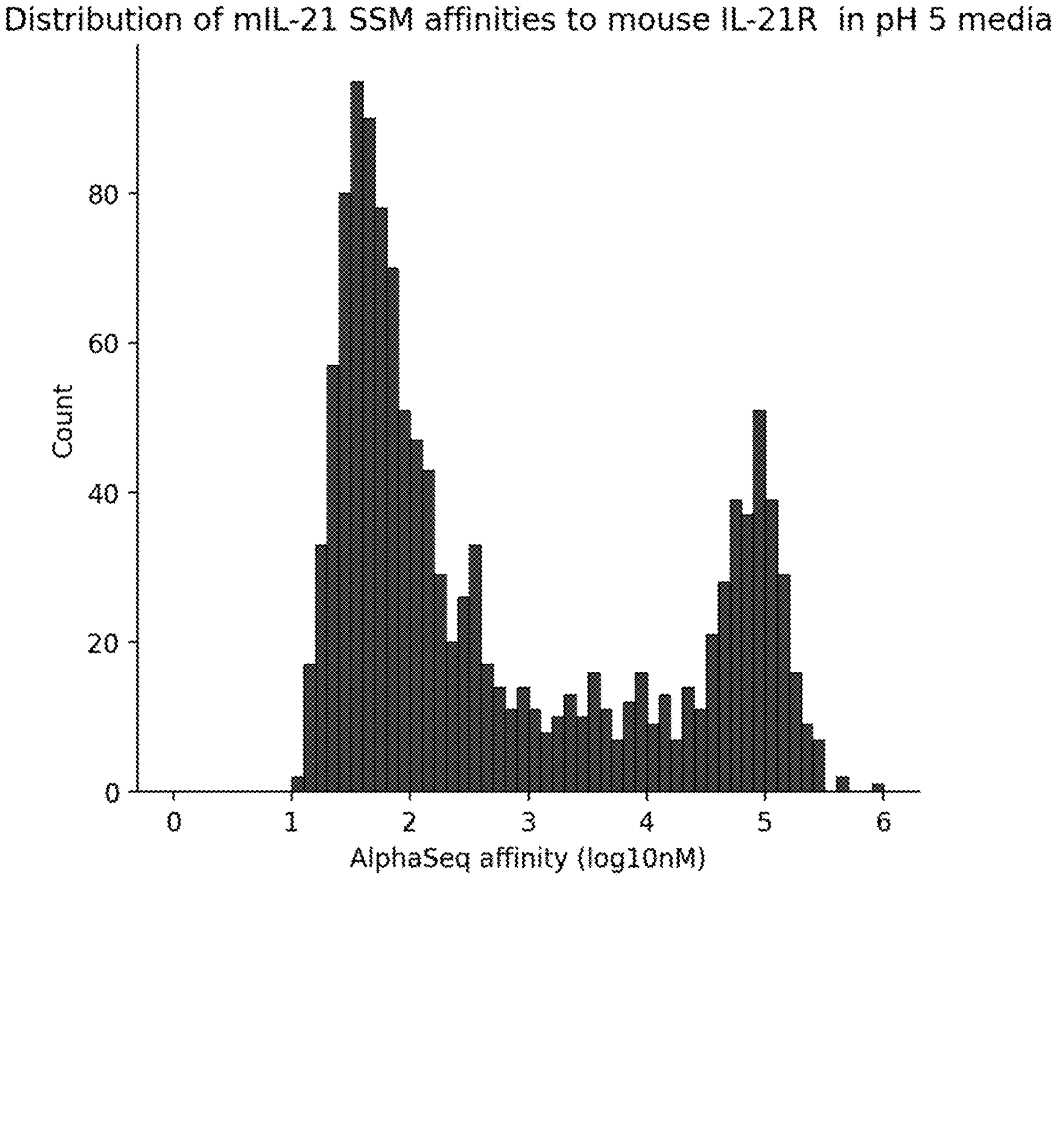
FIG. 8B is a histogram of AlphaSeq™ affinity values for the full mouse IL-21 SSM binding to mouse IL-21R in pH 5 media.
Figure 8C:
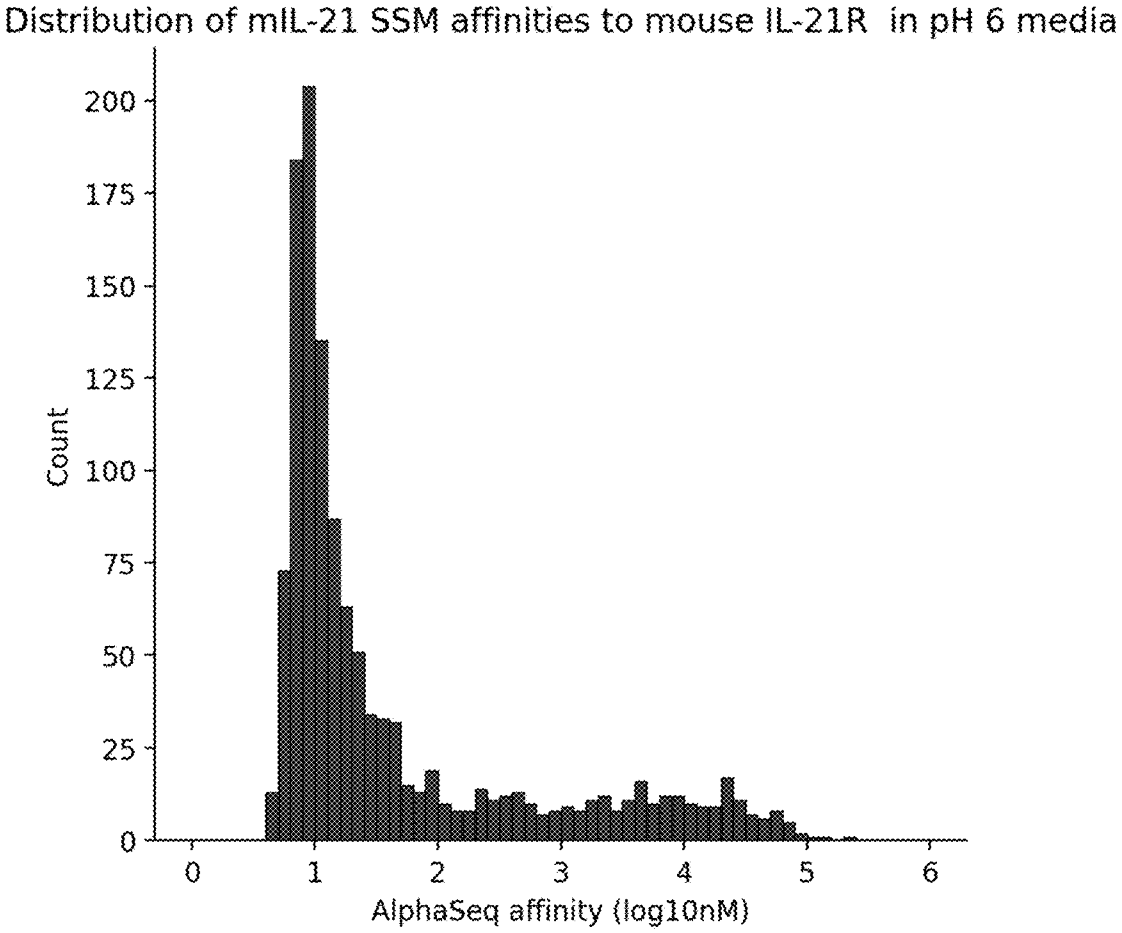
FIG. 8C is a histogram of AlphaSeq™ affinity values for the full mouse IL-21 SSM binding to mouse IL-21R in pH 6 media.
Figure 8D:
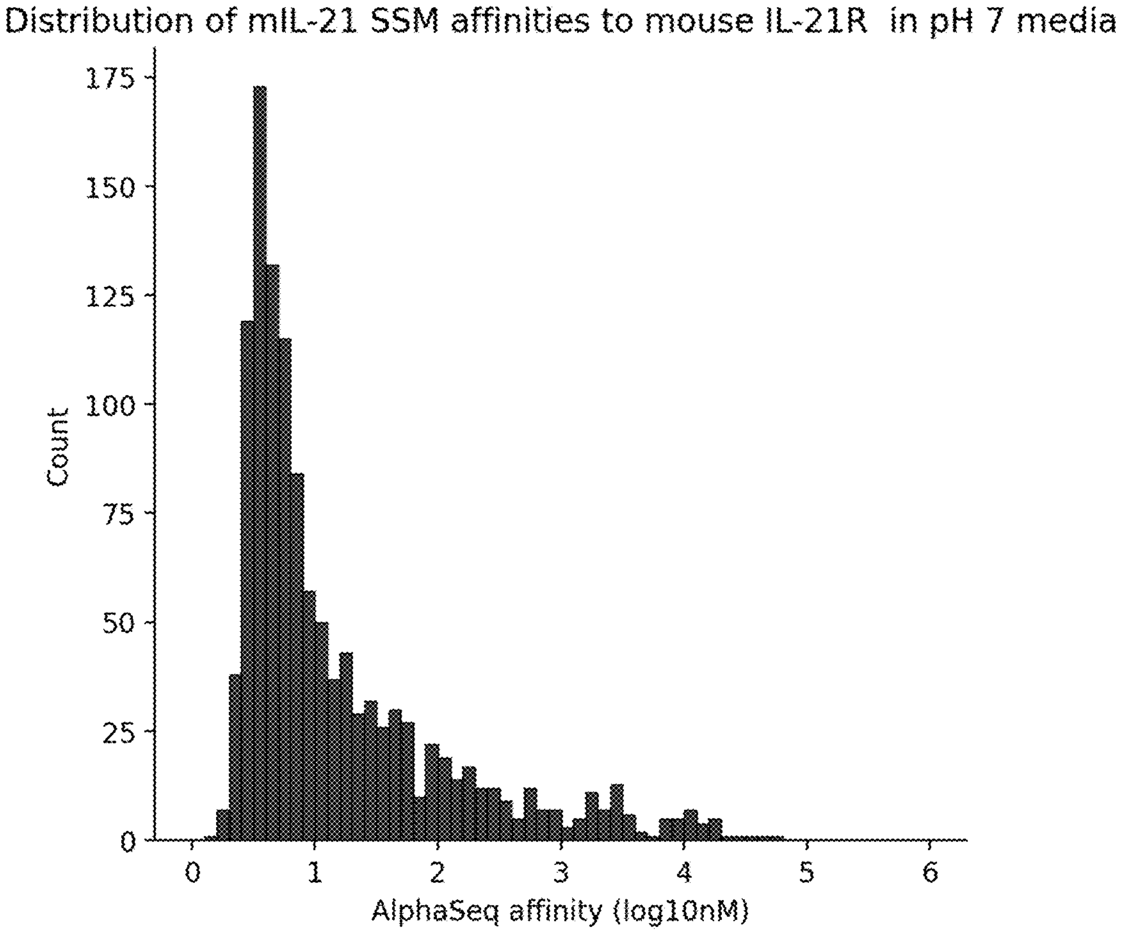
FIG. 8D is a histogram of AlphaSeq™ affinity values for the full mouse IL-21 SSM binding to mouse IL-21R in pH 7 media.

For each mIL-21 variant, an affinity for mouse IL-21R was obtained and an expression score was measured. After filtering AlphaSeq™ results to include only variants with average expression bin >2.0, the average affinity between the 120 wild-type mIL-21 replicates and mouse IL-21R was found to be 777 nM in unbuffered media (log 10 nM=2.9 in FIG. 7A), 32 nM in pH 5 media (log 10 nM=1.5 in FIG. 7B), 7.3 nM in pH 6 media (log 10 nM=0.9 in FIG. 7C), and 3.1 nM in pH 7 media (log 10 nM=0.5 in FIG. 7D). The distribution of mIL-21 SSM mutant affinities to mouse IL-21R are shown in unbuffered media (FIG. 8A), pH 5 media (FIG. 8B), pH 6 media (FIG. 8C), and pH 7 media (FIG. 8D). In contrast to the wild-type affinity values, which show a tight distribution, the mIL-21 variants show a wide range of affinities, spanning from wild-type levels of binding to background-level binding. The minimal criteria for considering a mouse variant detuned were as follows: expression >2.0 on a scale where no expression=1.0 and maximum expression=3.0; affinity measurements representing a half-log reduction in binding affinity from wild-type mouse IL-21 in at least one of the tested media conditions. This value varied depending on the media condition used:

Unbuffered detuned variant cutoff: 2.5 M (log 10 nM=3.4)

pH 7:10 nM (log 10 nM=1.0)

pH 6:23 nM (log 10 nM=1.4)

pH 5:101 nM (log 10 nM=2.0)

These criteria lead to a total of 812 mIL-21 variants (Table 3), of which 690 retain binding affinity above the approximate limit of detection of the assay (limit of detection defined as 2 standard deviations stronger affinity than the mean of negative control interactions).

Figure 9A:
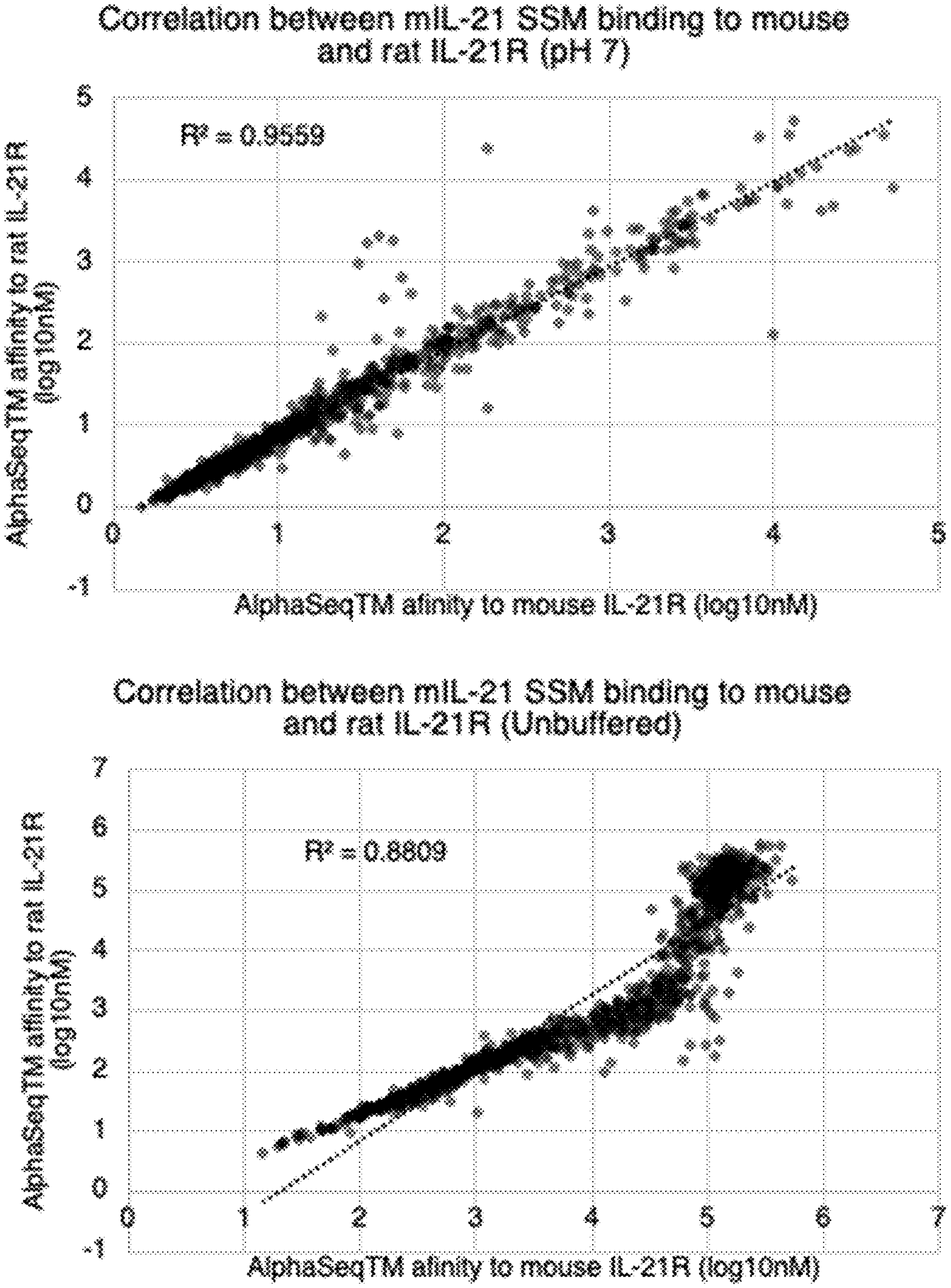
FIG. 9A is a scatter plot showing the relationship between AlphaSeq™ affinity to mouse IL-21R (x-axis) and AlphaSeq™ affinity to rat IL-21R (y-axis) for each variant in the mouse IL-21 SSM library, measured in pH 7 media (left) and unbuffered media (right).
Figure 9B:
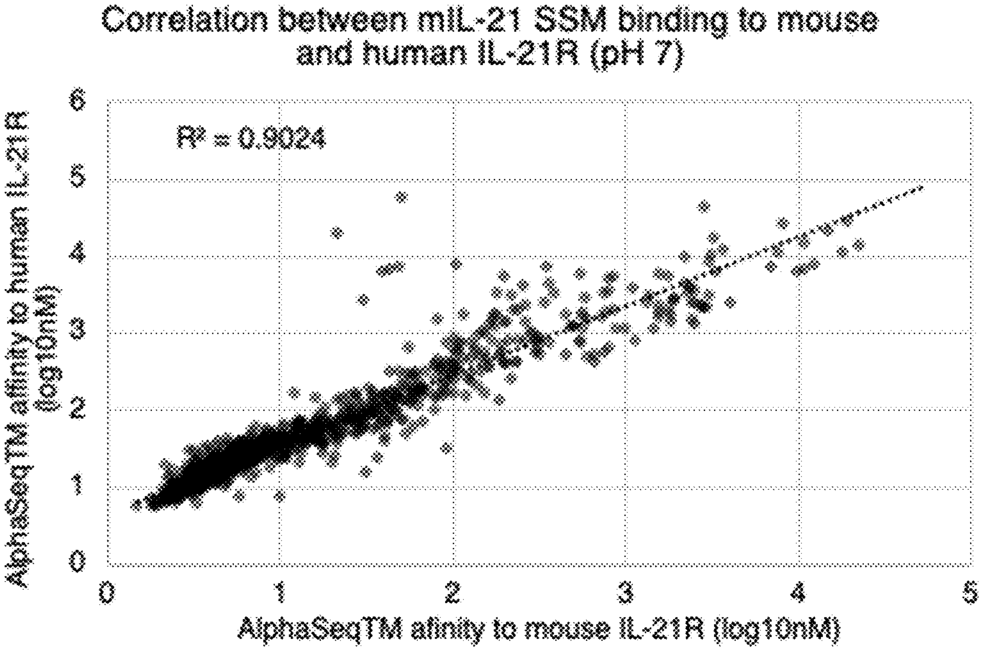
FIG. 9B is a scatter plot showing the relationship between AlphaSeq™ affinity to mouse IL-21R (x-axis) and AlphaSeq™ affinity to human IL-21R (y-axis) for each variant in the mouse IL-21 SSM library, measured in pH 7 media (left) and unbuffered media (right).
Figure 9B:
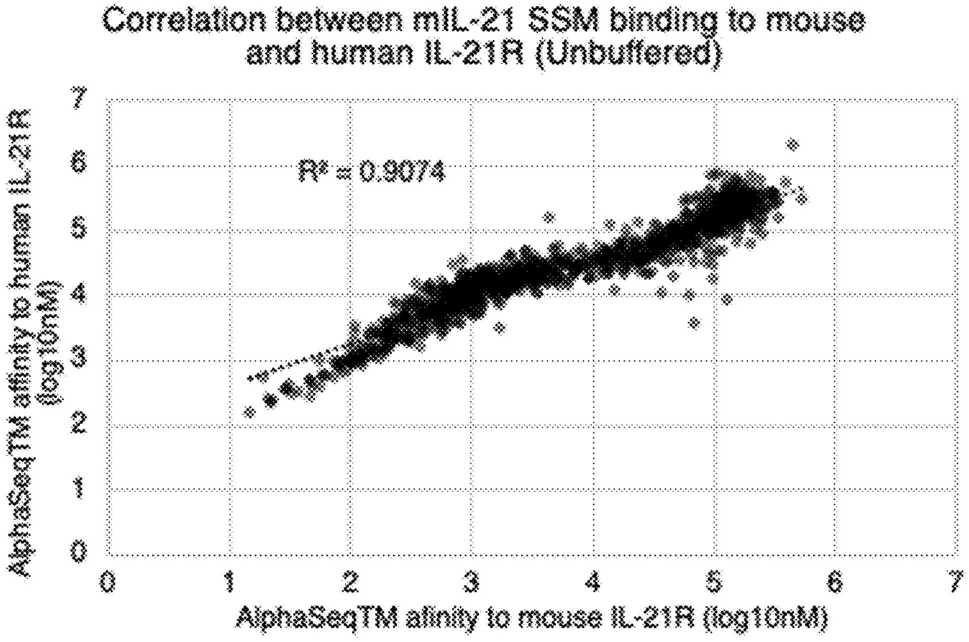
Figure 9C:
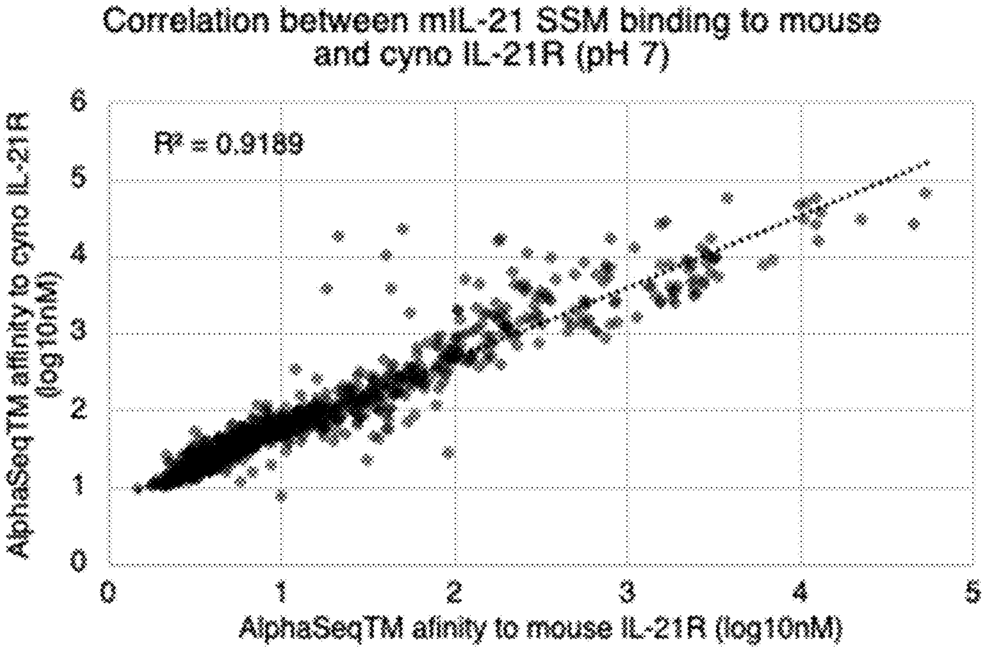
FIG. 9C is a scatter plot showing the relationship between AlphaSeq™ affinity to mouse IL-21R (x-axis) and AlphaSeq™ affinity to cynomolgus monkey IL-21R (y-axis) for each variant in the mouse IL-21 SSM library, measured in pH 7 media (left) and unbuffered media (right).
Figure 9C:
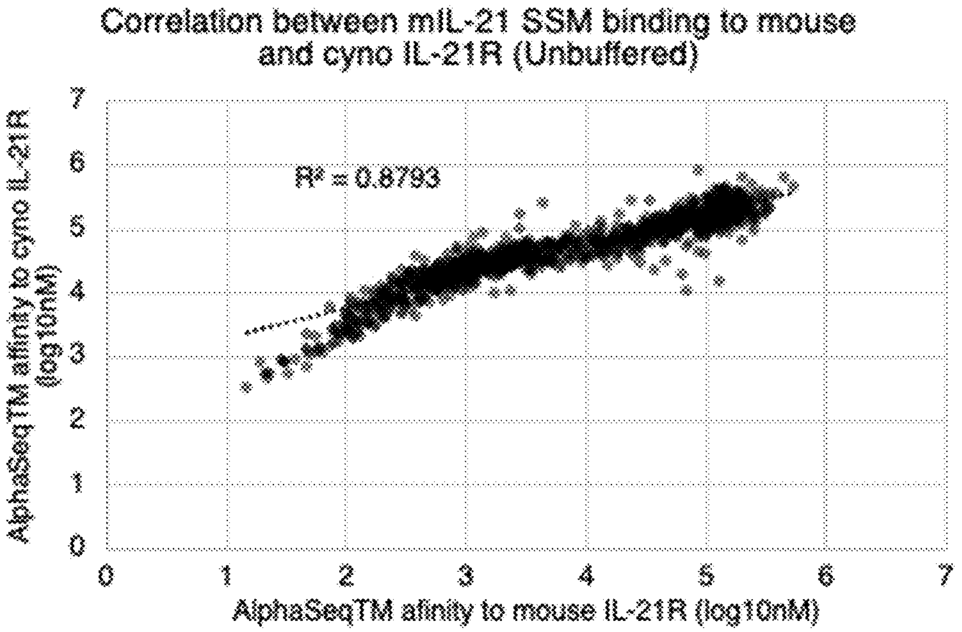

The AlphaSeq™ platform allowed simultaneous measurement of mIL-21 variant affinities to cyno, rat, and mouse orthologs of IL-21R. Mouse IL-21 variant detuning to mouse IL-21R was highly correlated with the degree of detuning to rat IL-21R (FIG. 9A), human IL-21R (FIG. 9B), and cyno IL-21R (FIG. 9C).

The results for screening of interaction between human IL-21 variants and human IL-21R under each condition are provided in Table 1. The results for screening of interaction between mouse IL-21 variants and mouse IL-21R under each condition are provided in Table 3.

Further selection criteria were applied to the 273 human IL-21 variants and 812 mouse IL-21 variants identified as being detuned for prioritizing candidate molecules for further functional characterization. Those criteria included: formation of ≥50 diploids (unbuffered) or ≥10 diploids (buffered) in the AlphaSeq™ assay; identification of multiple substitutions at the same position that lead to detuning (termed the "multiplicity" for that position); diversity of positions on the IL-21 structure; amino acid conservation across human, cyno, mouse, and rat IL-21; conserved detuned positions between human and mouse IL-21. Using these criteria, a list of 35 human IL-21 and 36 mouse IL-21 variants were selected to express as soluble proteins for biochemical and functional characterization (Table 4).

TABLE 4

Characterizing Prioritized Human IL-21 Variants as Soluble Fc Fusion Proteins for Binding $K_d$ Values and Potency EC50 Values

| variant | IL21RA_human Kd, BLI (M) | IL21RA_mouse Kd, BLI (M) | Human T cell EC50 (pM) | Mouse T cell EC50 (pM) |
|---|---|---|---|---|
| IL-21_human_WT | 1.48E−09 | 5.47E−09 | 1.3E+00 | Not tested |
| IL-21_human_D33P | 9.03E−09 | 1.98E−08 | 9.3E+00 | 1.8E+03 |
| IL-21_human_S74H | 1.23E−08 | 1.93E−08 | 3.6E+00 | 1.9E+03 |
| IL-21_human_Y52Q | 1.44E−08 | 1.94E−08 | 8.7E+00 | 9.2E+03 |
| IL-21_human_W73L | 2.28E−08 | 1.99E−08 | 1.5E+01 | 6.9E+03 |
| IL-21_human_V53T | 7.86E−09 | 5.09E−09 | Not tested | Not tested |
| IL-21_human_R34S | 3.15E−08 | 2.87E−08 | 5.6E+00 | 8.5E+03 |
| IL-21_human_P108L | 3.21E−09 | 1.18E−08 | 1.1E+00 | 7.1E+04 |
| IL-21_human_I45A | 1.94E−09 | 1.26E−08 | 1.3E+00 | NA |
| IL-21_human_E72S | 9.65E−09 | 7.75E−09 | 3.1E+01 | 4.7E+04 |
| IL-21_human_I37V | 3.02E−09 | 5.27E−09 | Not tested | Not tested |
| IL-21_human_F76M | 1.18E−08 | NA | Not tested | Not tested |
| IL-21_human_I43M | 7.02E−09 | 9.04E−09 | Not tested | Not tested |
| IL-21_human_F76E | NA | NA | Not tested | Not tested |
| IL-21_human_R38K | 3.13E−07 | 2.62E−07 | Not tested | Not tested |
| IL-21_human_R38Q | 8.96E−08 | 2.46E−07 | Not tested | Not tested |
| IL-21_human_F79P | 1.11E−08 | NA | Not tested | Not tested |
| IL-21_human_R38M | 8.79E−08 | 1.89E−07 | Not tested | Not tested |
| IL-21_human_D44P | 1.36E−06 | NA | Not tested | Not tested |
| IL-21_human_K106S | 5.78E−09 | 2.40E−08 | Not tested | Not tested |
| IL-21_human_I45G | 1.20E−08 | NA | Not tested | Not tested |
| IL-21_human_V53N | 8.71E−08 | NA | Not tested | Not tested |
| IL-21_human_W73V | 6.30E−09 | 1.06E−07 | Not tested | Not tested |
| IL-21_human_R34D | 6.21E−08 | 1.03E−07 | Not tested | Not tested |
| IL-21_human_I37G | 6.17E−08 | 1.59E−07 | Not tested | Not tested |
| IL-21_human_I45H | 2.90E−08 | 1.24E−07 | Not tested | Not tested |
| IL-21_human_Y52D | 9.30E−09 | 2.70E−07 | Not tested | Not tested |
| IL-21_human_I95H | 1.60E−08 | 8.49E−07 | Not tested | Not tested |
| IL-21_human_P108G | 2.90E−08 | NA | Not tested | Not tested |
| IL-21_human_L42Q | 6.09E−08 | NA | Not tested | Not tested |
| IL-21_human_I148S | 2.45E−09 | 6.46E−09 | Not tested | Not tested |
| IL-21_human_D33T | 1.48E−08 | 3.74E−08 | Not tested | Not tested |
| IL-21_human_R105K | 1.67E−08 | 4.13E−08 | Not tested | Not tested |
| IL-21_human_I37R | 9.97E−09 | 3.51E−08 | Not tested | Not tested |
| IL-21_human_I45D | NA | NA | Not tested | Not tested |
| IL-21_human_E72L | 4.40E−09 | 1.23E−08 | Not tested | Not tested |
| IL-21_mouse_WT | 6.38E−09 | 5.08E−09 | Not tested | 6.7E+00 |
| IL-21_mouse_D26P | NA | 4.02E−08 | Not tested | 2.6E+01 |
| IL-21_mouse_P101L | NA | NA | Not tested | 2.5E+03 |
| IL-21_mouse_R27S | 2.22E−08 | 1.09E−08 | Not tested | 1.8E+01 |
| IL-21_mouse_I30V | 8.86E−09 | 6.15E−09 | Not tested | 5.8E+00 |
| IL-21_mouse_Y45Q | 8.37E−09 | 7.05E−09 | Not tested | 8.2E+01 |
| IL-21_mouse_I38A | 4.61E−09 | 6.61E−09 | Not tested | 1.4E+02 |
| IL-21_mouse_F88D | 5.94E−09 | 3.26E−09 | Not tested | 5.7E+00 |
| IL-21_mouse_F69M | 9.19E−09 | 5.65E−09 | Not tested | 6.7E+00 |
| IL-21_mouse_R99L | 1.05E−08 | 6.59E−09 | Not tested | 2.0E+01 |
| IL-21_mouse_Q95S | 9.35E−09 | 6.61E−09 | Not tested | 2.9E+01 |
| IL-21_mouse_R97V | NA | NA | Not tested | 1.4E+02 |
| IL-21_mouse_L96M | 4.52E−09 | 6.11E−09 | Not tested | 7.6E+01 |
| IL-21_mouse_F72R | NA | NA | Not tested | NA |
| IL-21_mouse_L32R | NA | NA | Not tested | NA |
| IL-21_mouse_P57E | 1.05E−07 | 2.16E−08 | Not tested | NA |

TABLE 4-continued

Characterizing Prioritized Human IL-21 Variants as Soluble Fc Fusion Proteins for Binding $K_d$ Values and Potency EC50 Values

| variant | IL21RA_human Kd, BLI (M) | IL21RA_mouse Kd, BLI (M) | Human T cell EC50 (pM) | Mouse T cell EC50 (pM) |
|---|---|---|---|---|
| IL-21_mouse_A56D | 7.32E−09 | 4.77E−09 | Not tested | NA |
| IL-21_mouse_I38D | 4.58E−09 | 0.00E+00 | Not tested | 1.39E+04 |
| IL-21_mouse_L92E | 3.54E−09 | 1.04E−08 | Not tested | 1.47E+04 |
| IL-21_mouse_L130W | NA | 1.20E−08 | Not tested | NA |
| IL-21_mouse_I38G | NA | NA | Not tested | NA |
| IL-21_mouse_L35K | NA | NA | Not tested | 1.14E+04 |
| IL-21_mouse_F69H | NA | 1.33E−09 | Not tested | 2.63E+04 |
| IL-21_mouse_N85I | NA | NA | Not tested | 5.25E+03 |
| IL-21_mouse_P101G | 4.39E−09 | NA | Not tested | 6.55E+02 |
| IL-21_mouse_L100S | 1.99E−07 | 8.71E−09 | Not tested | 1.05E+04 |
| IL-21_mouse_V60K | 4.01E−08 | 1.40E−08 | Not tested | 4.42E+03 |
| IL-21_mouse_I89D | 3.19E−09 | 6.07E−09 | Not tested | 1.07E+04 |
| IL-21_mouse_R27D | 1.51E−07 | 9.08E−08 | Not tested | 3.45E+02 |
| IL-21_mouse_A68E | NA | 4.34E−09 | Not tested | 1.33E+04 |
| IL-21_mouse_V39Q | NA | NA | Not tested | NA |
| IL-21_mouse_D37P | 2.50E−09 | NA | Not tested | 1.46E+03 |
| IL-21_mouse_Y45D | 4.31E−09 | NA | Not tested | 5.10E+03 |
| IL-21_mouse_R98A | NA | 4.27E−08 | Not tested | 6.00E+01 |
| IL-21_mouse_I30R | NA | 1.35E−08 | Not tested | 1.00E+01 |
| IL-21_mouse_I141S | 4.72E−11 | 3.07E−09 | Not tested | 5.25E+02 |
| IL-21_mouse_D26T | NA | 6.85E−10 | Not tested | 3.50E+01 |

Note:
"Not tested" indicates that the protein was not tested by this assay. "NA" indicates that the protein was tested, but the value was outside the limit of detection of the assay.

Example 3: Expression and Characterization of Detuned IL-21 Variant Fc Fusion Proteins Cytokine variant sequences identified with appropriate AlphaSeq™ expression and detuned affinity were nominated for recombinant protein expression. Double stranded DNA fragments coding the identified variant sequence were synthesized by Twist Biosciences which included flanking sequences to facilitate cloning into the pCDNA3.1(+) mammalian cell expression vector. The commercial vector had been modified to encode the human IgG1 Fc sequence containing effectorless function mutations. Variant cytokine insert fragments were cloned into the modified expression vector using Gibson Assembly and transformed into host TOP10 *E. Coli* competent cells. Cytokine sequence of interest was verified by Sanger sequencing. Confirmed sequence plasmid DNA was isolated from bacteria cultures using commercial DNA miniprep kits. The ExpiCHO™ mammalian cell line was thawed and cultured according to manufacturer instructions. Transient transfection of ExpiCHO™ cells was performed with detuned cytokine Fc construct DNA according to ExpiCHO™ transfection kit specifications and cultured supernatants were harvested 7 days later. Cultured supernatants containing proteins of interest were passed through a Protein A column using an AKTA FPLC instrument and eluted with low pH buffer. Purified protein was formulated in 20 mM histidine at pH 6.0. Harvest titers and percent purity as measured by analytical size exclusion chromatography (ASEC) are shown in Table 5.

TABLE 5

Protein Expression Yields and Purity for IL-21-Fc Fusion Proteins

| Variant | Titer (ug/mL) | Percent main peak |
|---|---|---|
| IL-21_human_WT | 53.569 | 87.433 |
| IL-21_human_D33P | 47.613 | 91.88 |
| IL-21_human_S74H | 54.99 | 90.669 |
| IL-21_human_Y52Q | 61.543 | 92.491 |

TABLE 5-continued

Protein Expression Yields and Purity for IL-21-Fc Fusion Proteins

| Variant | Titer (ug/mL) | Percent main peak |
|---|---|---|
| IL-21_human_W73L | 67.435 | 90.091 |
| IL-21_human_V53T | 23.608 | 87.441 |
| IL-21_human_R34S | 57.635 | 93.742 |
| IL-21_human_P108L | 100.476 | 91.886 |
| IL-21_human_I45A | 82.273 | 90.594 |
| IL-21_human_E72S | 10.972 | 42.467 |
| IL-21_human_I37V | 44.597 | 91.921 |
| IL-21_human_F76M | 10.769 | 80.814 |
| IL-21_human_I43M | 51.717 | 81.806 |
| IL-21_human_F76E | 140.103 | 91.836 |
| IL-21_human_R38K | 79.113 | 94.544 |
| IL-21_human_R38Q | 166.941 | 95.123 |
| IL-21_human_F79P | 84.973 | 89.576 |
| IL-21_human_R38M | 138.504 | 95.266 |
| IL-21_human_D44P | 155.63 | 91.363 |
| IL-21_human_K106S | 108.406 | 86.763 |
| IL-21_human_I45G | 13.134 | 85.701 |
| IL-21_human_V53N | 127.984 | 89.068 |
| IL-21_human_W73V | 102.27 | 89.812 |
| IL-21_human_R34D | 80.043 | 81.76 |
| IL-21_human_I37G | 68.353 | 90.082 |
| IL-21_human_I45H | 267.795 | 92.724 |
| IL-21_human_Y52D | 108.789 | 77.088 |
| IL-21_human_I95H | 108.818 | 87.131 |
| IL-21_human_P108G | 23.049 | 79.61 |
| IL-21_human_L42Q | 133.326 | 85.191 |
| IL-21_human_I148S | 8.69 | 52.633 |
| IL-21_human_D33T | 96.5 | 90.943 |
| IL-21_human_R105K | 137.531 | 90.406 |
| IL-21_human_I37R | 112.868 | 90.326 |
| IL-21_human_I45D | 196.65 | 94.388 |
| IL-21_human_E72L | 285.652 | 88.349 |
| IL-21_mouse_WT | 54.734 | 64.805 |
| IL-21_mouse_D26P | 15.761 | 76.741 |
| IL-21_mouse_P101L | 37.509 | 79.028 |
| IL-21_mouse_R27S | 48.447 | 81.367 |
| IL-21_mouse_I30V | 48.438 | 85.922 |

TABLE 5-continued

Protein Expression Yields and Purity for IL-21-Fc Fusion Proteins

| Variant | Titer (ug/mL) | Percent main peak |
|---|---|---|
| IL-21_mouse_Y45Q | 43.971 | 81.276 |
| IL-21_mouse_I38A | 38.539 | 87.714 |
| IL-21_mouse_F88D | 55.471 | 67.994 |
| IL-21_mouse_F69M | 56.085 | 83.685 |
| IL-21_mouse_R99L | 37.203 | 77.646 |
| IL-21_mouse_Q95S | 36.764 | 70.976 |
| IL-21_mouse_R97V | 18.309 | 76.928 |
| IL-21_mouse_L96M | 24.517 | 72.24 |
| IL-21_mouse_F72R | 70.036 | 71.721 |
| IL-21_mouse_L32R | 16.845 | 88.081 |
| IL-21_mouse_P57E | 40.411 | 65.04 |
| IL-21_mouse_A56D | 48.387 | 60.11 |
| IL-21_mouse_I38D | 114.926 | 87.478 |
| IL-21_mouse_L92E | 97.558 | 68.283 |
| IL-21_mouse_L130W | 50.266 | 64.038 |
| IL-21_mouse_I38G | 110.045 | 92.937 |
| IL-21_mouse_L35K | 21.855 | 23.419 |
| IL-21_mouse_F69H | 54.216 | 50.297 |
| IL-21_mouse_N85I | 37.637 | 51.2 |
| IL-21_mouse_P101G | 48.553 | 51.112 |
| IL-21_mouse_L100S | 59.417 | 46.623 |
| IL-21_mouse_V60K | 69.441 | 52.916 |
| IL-21_mouse_I89D | 83.519 | 38.905 |
| IL-21_mouse_R27D | 82.515 | 40.281 |
| IL-21_mouse_A68E | 60.369 | 42.21 |
| IL-21_mouse_V39Q | 18.848 | 51.411 |
| IL-21_mouse_D37P | 72.93 | 82.457 |
| IL-21_mouse_Y45D | 73.758 | 81.658 |
| IL-21_mouse_R98A | 70.668 | 67.686 |
| IL-21_mouse_I30R | 101.043 | 49.887 |
| IL-21_mouse_I141S | 56.028 | 62.483 |
| IL-21_mouse_D26T | 55.221 | 52.216 |

The binding kinetics for IL-21 variant Fc fusion proteins were determined by bio-layer interferometry analysis on a Gator Prime instrument. This assay was performed by immobilizing commercially available recombinant human IL-21R His tag (Acro Biosystems) to anti-His biosensors (Gator). Protein A purified IL-21 variant Fc fusion proteins association to and dissociation from the immobilized IL-21R was observed at the same concentration for all variants observed. Binding of all human and mouse IL-21 variants were measured against both human and mouse IL-21R.

Specifically, anti-His probes were hydrated in kinetics buffer (1×PBS with 0.2% BSA and 0.02% Tween-20) for 10 minutes and IL-21R his tag antigen was immobilized to the anti-his probe for 180 seconds. Association was observed by placing probes with immobilized antigen into wells containing IL-21 variant Fc fusion proteins for 120 seconds. Dissociation was measured after transferring the biosensors into wells containing only kinetics buffer for 120 seconds.

All assay steps were performed with shaking at 1000 rpm at 30° C. Off rate (koff) analysis for this assay were determined using the Gator software provided from the manufacturer using data points collected from the first 20 seconds of dissociation. Results of the kinetic studies are presented in Table 4. Using bio-layer interferometry (BLI), the variants demonstrated a range of binding affinities to IL-21R, including strong cross-reactivity between human and mouse.

A subset of human IL-21 Fc fusion variants were tested for signaling potency in primary human PBMCs using a phosphorylated STAT3 flow cytometry assay (pSTAT3 phosflow). Previously frozen human PBMCs (Bloodworks-Bio) were thawed, washed, and counted to determine cell number and viability. Cells were plated in round-well bottom 96 well tissue culture plates for a total of 200,000 cells per well in 150 uL media. Wild-type and variant IL-21 Fc fusion proteins were added at concentrations ranging from 1 pM to 1 nM, and the cells were cultured for 30 minutes. Cytokine signaling was stopped by the addition of 50 ul of 4% paraformaldehyde for an additional 30 minutes.

Cells were centrifuged and washed with PBS/1% BSA followed by resuspension in ice cold methanol to permeabilize cells. After 30 minutes, cells were washed twice in PBS/1% BSA before resuspending in 50 ul PBS/1% BSA containing human Fc block (ThermoFisher) at recommended concentration. Cells were incubated on ice for 20 minutes and staining antibody panel was prepared.

Anti-human CD14-BV421, anti-human CD20-PE, anti-human CD3-PE-Cy5, anti-human CD4-eFluor450, and anti-pSTAT3 AF488 were added to cells at recommended concentrations in an additional 50 ul volume. Cells were stained with antibodies for 30 minutes before washing twice with PBS/1% BSA and analyzing on a ZE5 (Biorad) flow cytometer. Data was analyzed using Flowjo software and EC50 potency curves determined using Graphpad Prism. The tested human variants displayed a ~25-fold range of potencies. EC50 values are reported in Table 4.

Determination of IL-21-Fc variant (human and mouse) signaling in mouse splenocytes (BioIVT) was performed as in human PBMCs with the following modifications. Following thawing, cells were recovered in warm media for 2 hours at 37 C. Cells were labeled with a titration of IL-21-Fc variants ranging from 0.1 pM to 100 nM. The antibody panel used consisted of anti-mouse CD11b-BV421, anti-mouse CD19 PE, anti-mouse CD3-PE-Cy5, anti-mouse CD4-eFluor450, and anti-pSTAT3 AF488. The tested mouse variants displayed a ~400-fold range of potencies, and some tested human variants demonstrated >1,000-fold potency reduction relative to wild-type mouse IL-21. EC50 values are reported in Table 4.

Example 4: Identification of Stabilized IL-21 Variants Using AlphaSeq™

Because of the relatively weak binding observed between IL-21 and IL-21R in unbuffered media (see, for examples, FIG. 4A) and the high frequency of IL-21 SSM variants with apparently enhanced affinity to IL-21R (FIG. 5A), it was hypothesized that variants with apparently enhanced affinity represented stabilized or expression-enhancing variants of IL-21. By defining putative stabilized variants as those with a half-log increase in apparent binding affinity to IL-21R relative to the wild-type average, 166 IL-21 single-mutant stabilized variants were identified. These 166 IL-21 single-mutant stabilized variants, predicted affinities, and amino acid sequences (SEQ ID NOs 293-458) are provided in Table 8 below. Such variants are desirable for their potential utility as IL-21-based therapeutics.

Figure 10A:
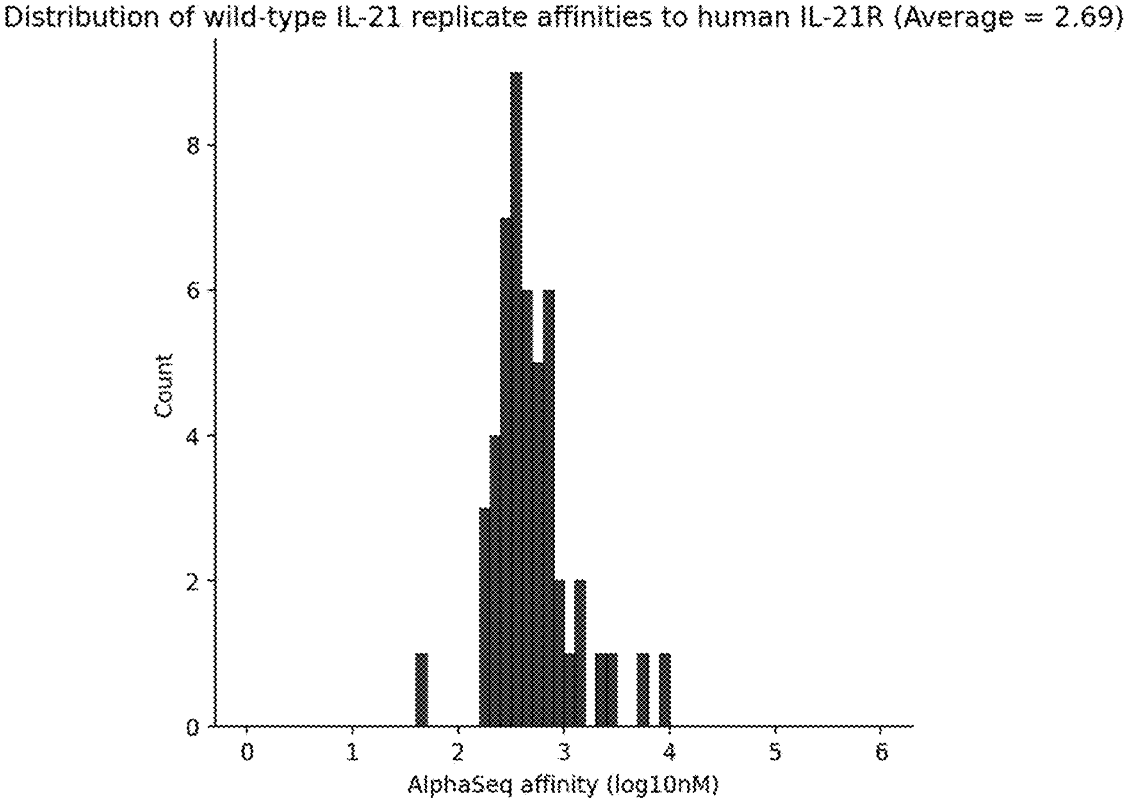
FIG. 10A is a histogram of AlphaSeq™ affinity values for the replicates of wild-type human IL-21 binding to human IL-21R in unbuffered media. These results serve as controls for the experiment in which stabilized IL-21 variants were identified, the results of which are shown in FIG. 10B.
Figure 10B:
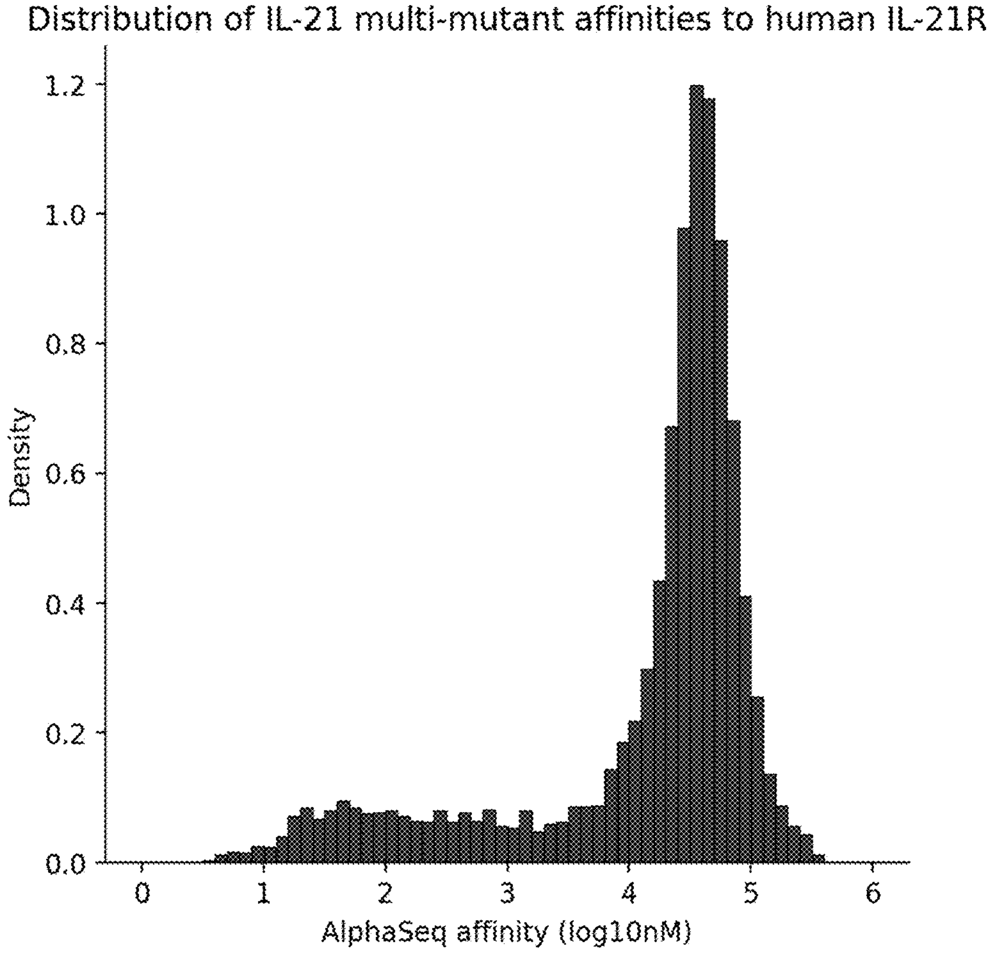
FIG. 10B is a histogram of AlphaSeq™ affinity values for a library of double, triple, quadruple, and quintuple mutant variants of human IL-21 binding to human IL-21R in unbuffered media.

Based on this hypothesis, a second library containing human IL-21 variants with 2, 3, 4, or 5 substitutions from wild-type IL-21 was generated and screened for binding to human IL-21R in unbuffered media. Wild-type copies of IL-21 were included and showed an affinity of 490 nM to IL-21R ($\log_{10}$ nM=2.69 in FIG. 10A). The variant library contained many IL-21 variants with reduced affinity to IL-21R, but also a set with increased affinity (FIG. 10B). By defining stabilized variants as those with a half-log increase in apparent binding affinity to IL-21R relative to the wild-type average, 425 stabilized variants were identified. These 425 stabilized variants, combinations of mutations, predicted affinities, and amino acid sequences (SEQ ID NOs 459-883) are provided in Table 9 below.

To test whether stabilized IL-21 variants identified using AlphaSeq™ also demonstrated improved expression or stability as soluble proteins, a subset of the highest apparent stabilized variants were produced as Fc fusion proteins in EpiCHO™ cells. In addition to producing top hits identified directly from AlphaSeq™, a subset of rational combinations of substitutions were also designed, spanning between 3 and 9 mutations from wild-type IL-21. The rationally designed combinations of substitutions and amino acid sequences are provided in Table 6 below. CHO expression titers and analytical SEC percent main peaks for IL-21 Fc fusions are shown in Table 7. Of the seven tested high-affinity variants identified in AlphaSeq™, three had increased CHO expression titers and purity relative to wild-type IL-21: IL-21_3610, IL-21_4177, and IL-21_0910. All of the five tested rationally designed IL-21 variants showed markedly increased titers, but only one had purity by analytical SEC>80%: IL-21_5mut.

TABLE 6

Rationally Combined IL-21 Variants

| Variant Name | Mutations | Sequence | SEQ ID NO |
|---|---|---|---|
| IL-21_9mut | H35F, N91E, K101E, N111E, R114G, R115G, H118D, R119T, T121E | MRSSPGNMERIVICLMVIFL GTLVHKSSSQGQDREMIRMR QLIDIVDQLKNYVNDLVPEF LPAPEDVETNCEWSAFSCFQ KAQLKSANTGENERIINVSI EKLKRKPPSTEAGGGQKDTL ECPSCDSYEKKPPKEFLERF KSLLQKMIHQHLSSRTHGSE DS | 288 |
| IL-21_3mut | H35F, N91E, K101E | MRSSPGNMERIVICLMVIFL GTLVHKSSSQGQDREMIRMR QLIDIVDQLKNYVNDLVPEF LPAPEDVETNCEWSAFSCFQ KAQLKSANTGENERIINVSI EKLKRKPPSTNAGRRQKHRL TCPSCDSYEKKPPKEFLERF KSLLQKMIHQHLSSRTHGSE DS | 289 |
| IL-21_6mut | N111E, R114G, R115G, H118D, R119T, T121E | MRSSPGNMERIVICLMVIFL GTLVHKSSSQGQDRHMIRMR QLIDIVDQLKNYVNDLVPEF LPAPEDVETNCEWSAFSCFQ KAQLKSANTGNNERIINVSI KKLKRKPPSTEAGGGQKDTL ECPSCDSYEKKPPKEFLERF KSLLQKMIHQHLSSRTHGSE DS | 290 |
| IL-21_4mut | N111E, R115G, H118D, T121E | MRSSPGNMERIVICLMVIFL GTLVHKSSSQGQDRHMIRMR QLIDIVDQLKNYVNDLVPEF LPAPEDVETNCEWSAFSCFQ KA QLKSANTGNNERIINVSIKK LKRKPPSTEAGRGQKDRLEC PSCDSYEKKPPKEFLERFKS LLQKMIHQHLSSRTHGSEDS | 291 |

TABLE 6-continued

Rationally Combined IL-21 Variants

| Variant Name | Mutations | Sequence | SEQ ID NO |
|---|---|---|---|
| IL-21_5mut | H35F, R114G, R115G, H118D, R119T, T121E | MRSSPGNMERIVICLMVIFL GTLVHKSSSQGQDREMIRMR QLIDIVDQLKNYVNDLVPEF LPAPEDVETNCEWSAFSCFQ KAQLKSANTGNNERIINVSI KKLKRKPPSTNAGGGQKDTL ECPSCDSYEKKPPKEFLERF KSLLQKMIHQHLSSRTHGSE DS | 292 |

TABLE 7

Protein Expression Yields and Purity for Stabilized IL-21-Fc Fusion Proteins

| Variant | Titer (ug/mL) | Percent main peak |
|---|---|---|
| IL-21_WT | 54.0 | 55.5 |
| IL-21_2988 | 68.6 | 48.2 |
| IL-21_3610 | 189.9 | 91.5 |
| IL-21_4177 | 114.0 | 90.2 |
| IL-21_4219 | 97.4 | 57.2 |
| IL-21_0910 | 186.1 | 82.0 |
| IL-21_4818 | 88.3 | 57.4 |
| IL-21_4687 | 47.1 | 15.4 |
| IL-21_9mut | 170.5 | 71.7 |
| IL-21_3mut | 249.4 | 67.8 |
| IL-21_6mut | 139.3 | 62.5 |
| IL-21_4mut | 141.3 | 67.2 |
| IL-21_5mut | 202.8 | 84.9 |

Figure 11:
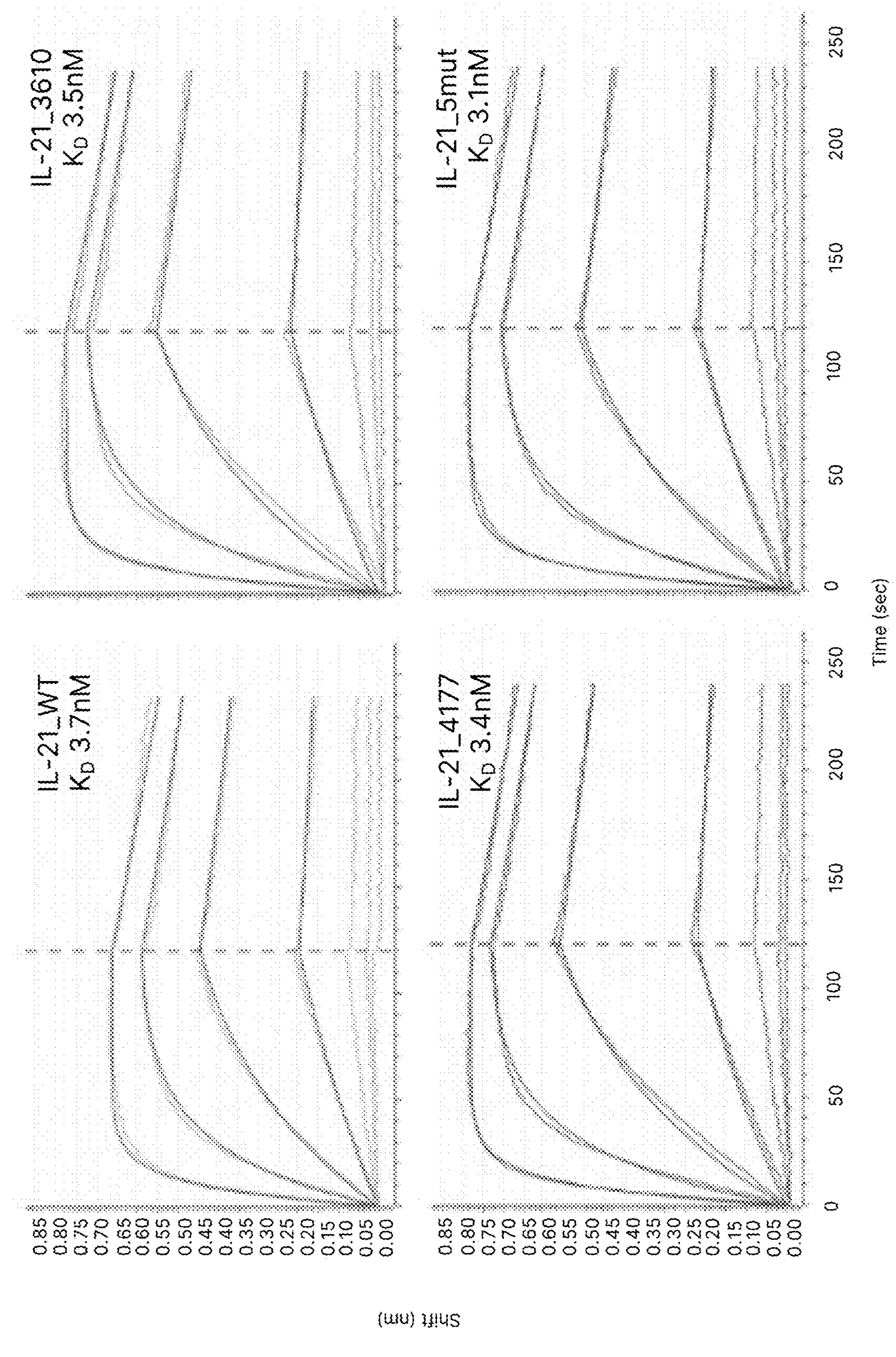
FIG. 11 shows BLI binding affinities for the interaction between human IL-21R and Fc fusions of wild-type human IL-21 and the three stabilized human IL-21 variants, IL-21_3610, IL-21_4177, and IL-21_5mut.
Figure 12:
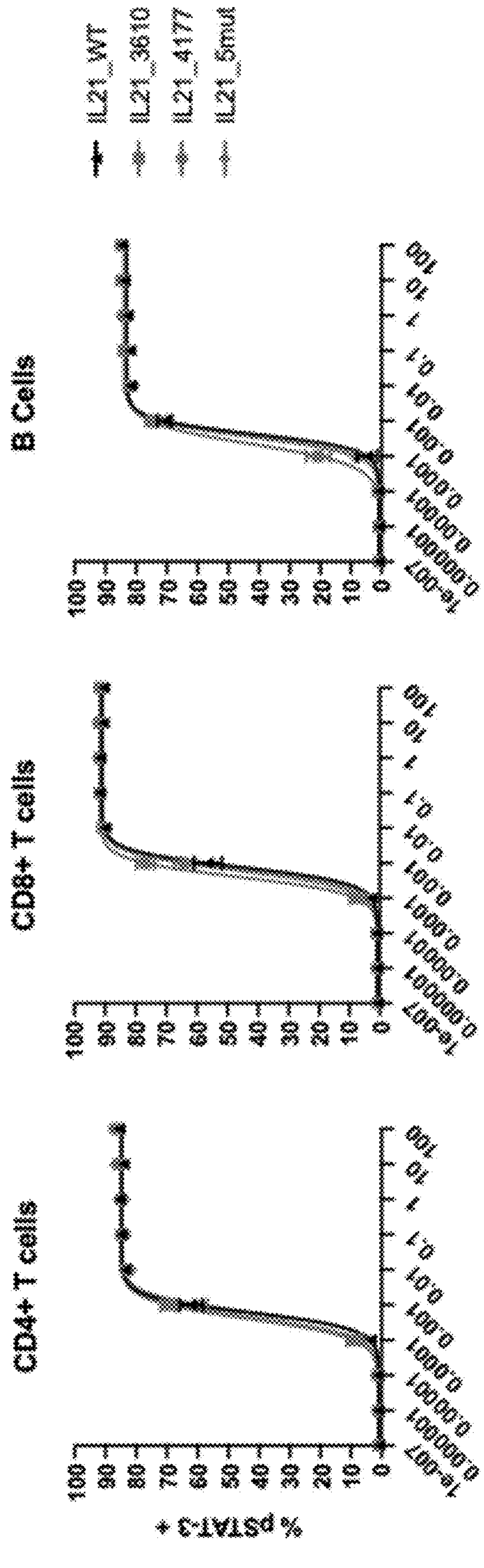
FIG. 12 shows the potency of wild-type human IL-21 and the three stabilized human IL-21 variants, IL-21_3610, IL-21_4177, and IL-21_5mut, measured as the EC50 for phosphorylation of STAT3 in a human PBMC Phosflow assay.

The three highest purity hits from tested IL-21-Fc fusions (IL-21_3610, IL-21_4177, and IL-21_5mut) were tested by BLI for binding affinity to IL-21R to confirm that stabilizing mutations did not affect the ability of IL-21 to bind its receptor (FIG. 11). The IL-21-Fc variants also did not show any change in signaling potency on human PBMCs relative to wild-type IL-21-Fc (FIG. 12).

Figure 13A:
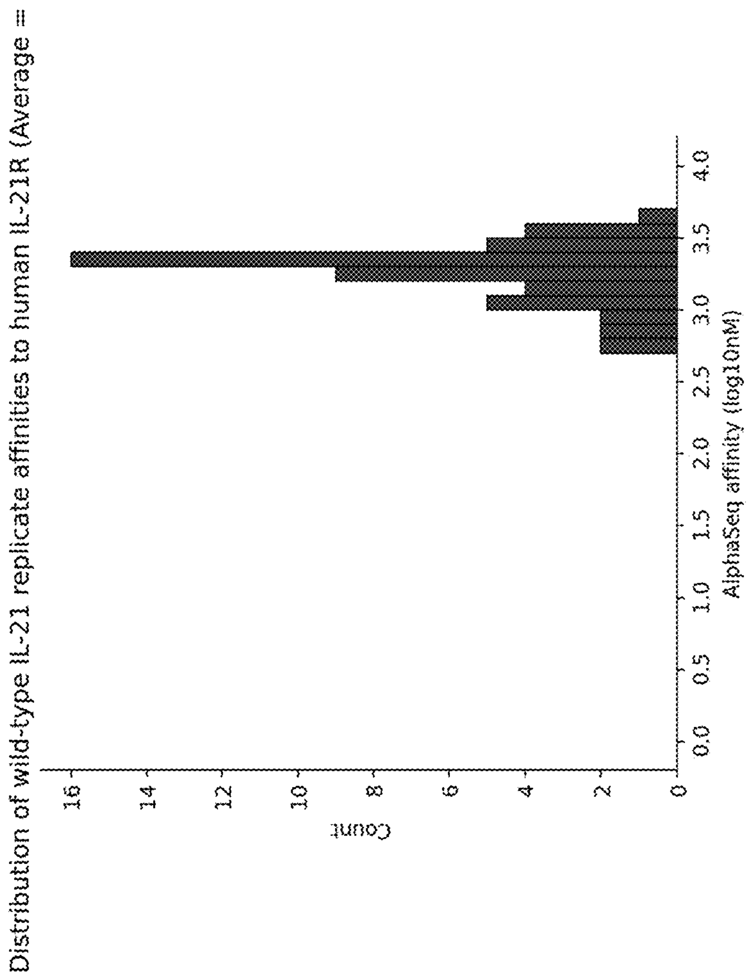
FIG. 13A is a histogram of AlphaSeq™ affinity values for the replicates of wild-type human IL-21 binding to human IL-21R in unbuffered media. These results serve as controls for the experiment in which combinations of stabilizing mutations were tested, the results of which are shown in FIG. 13B.
Figure 13B:
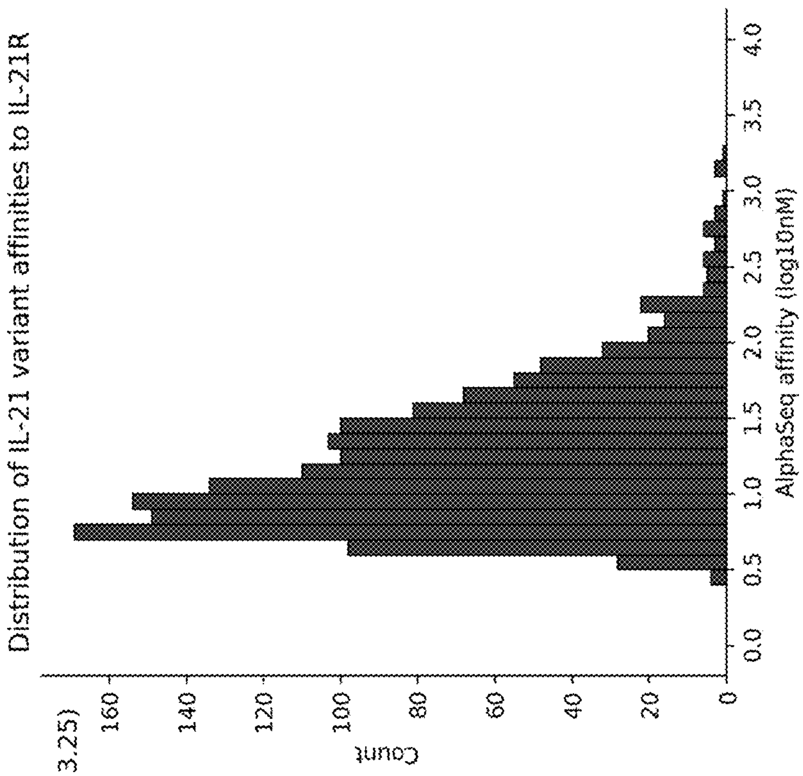
FIG. 13B is a histogram of AlphaSeq™ affinity values for a library of double, triple, and quadruple mutant variants of human IL-21 binding to human IL-21R in unbuffered media. These mutants were designed as combinations of substitutions that had stabilizing effects.
Figure 14A:
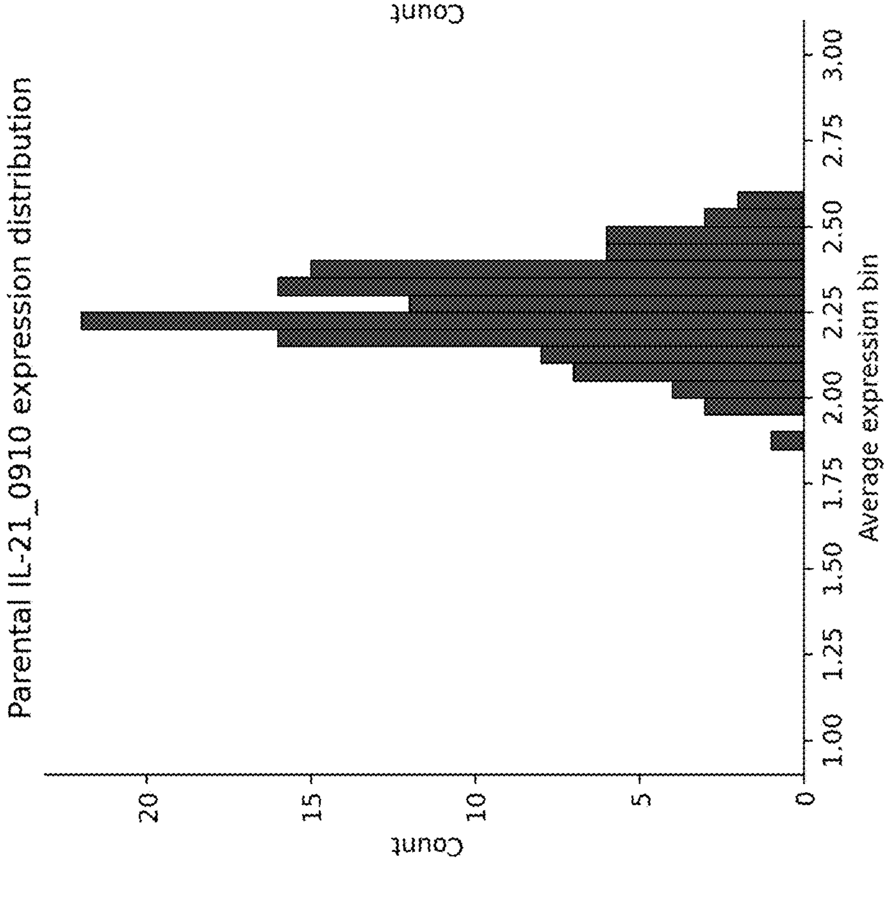
FIG. 14A is a histogram of expression values for replicates of parental human IL-21_0910. A value of 3 is the maximum possible expression in this assay and a value of 1 is the minimum possible expression.
Figure 14B:
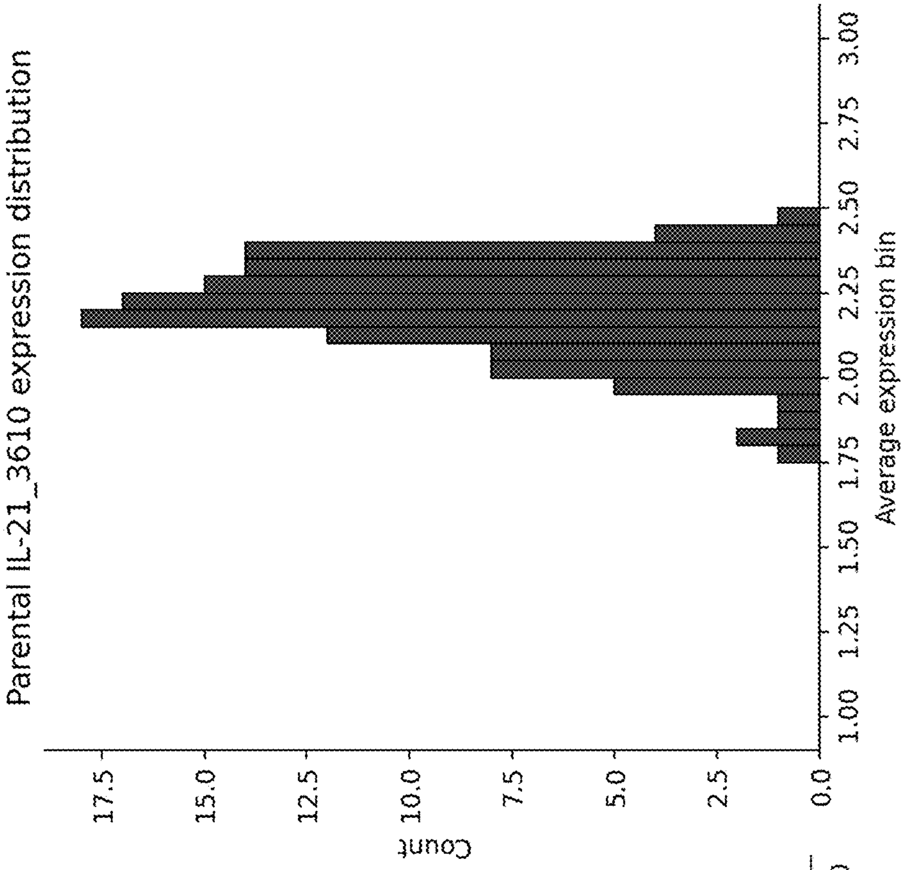
FIG. 14B is a histogram of expression values for replicates of parental human IL-21_3610. A value of 3 is the maximum possible expression in this assay and a value of 1 is the minimum possible expression.
Figure 14C:
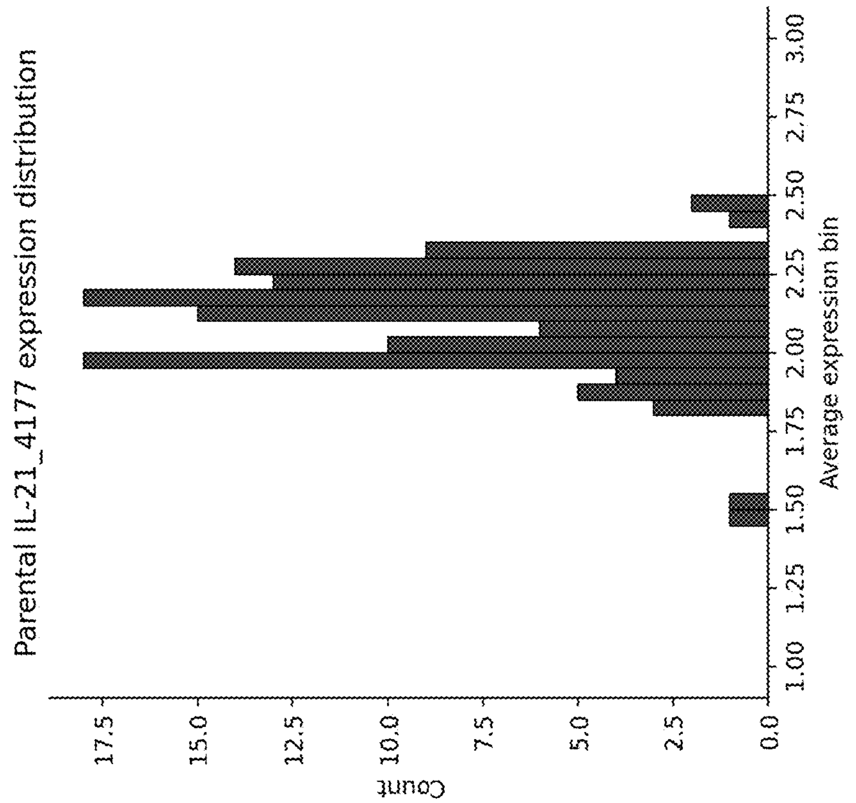
FIG. 14C is a histogram of expression values for replicates of parental human IL-21_4177. A value of 3 is the maximum possible expression in this assay and a value of 1 is the minimum possible expression.
Figure 14D:
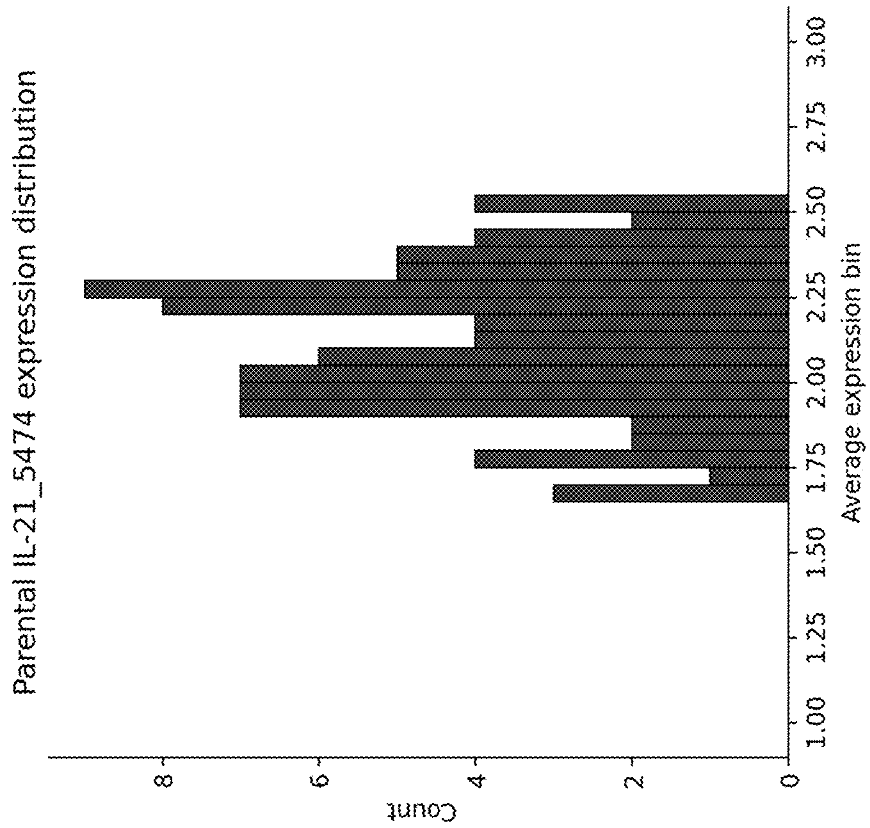
FIG. 14D is a histogram of expression values for replicates of parental human IL-21_5474. A value of 3 is the maximum possible expression in this assay and a value of 1 is the minimum possible expression.
Figure 14E:
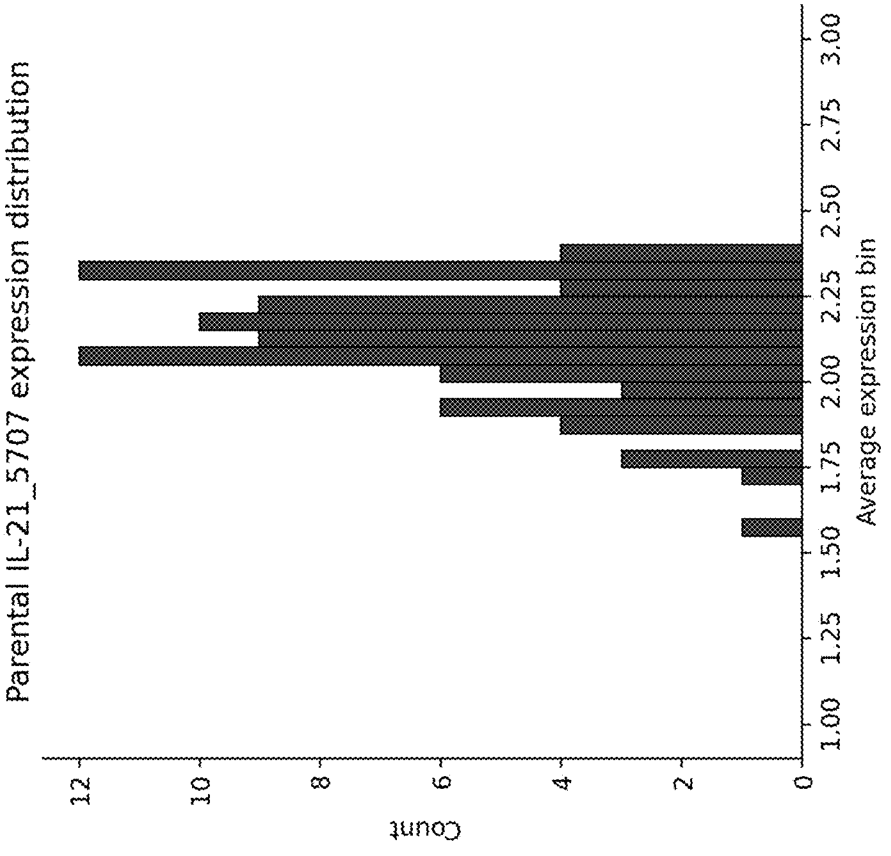
FIG. 14E is a histogram of expression values for replicates of parental human IL-21_5707. A value of 3 is the maximum possible expression in this assay and a value of 1 is the minimum possible expression.
Figure 14F:
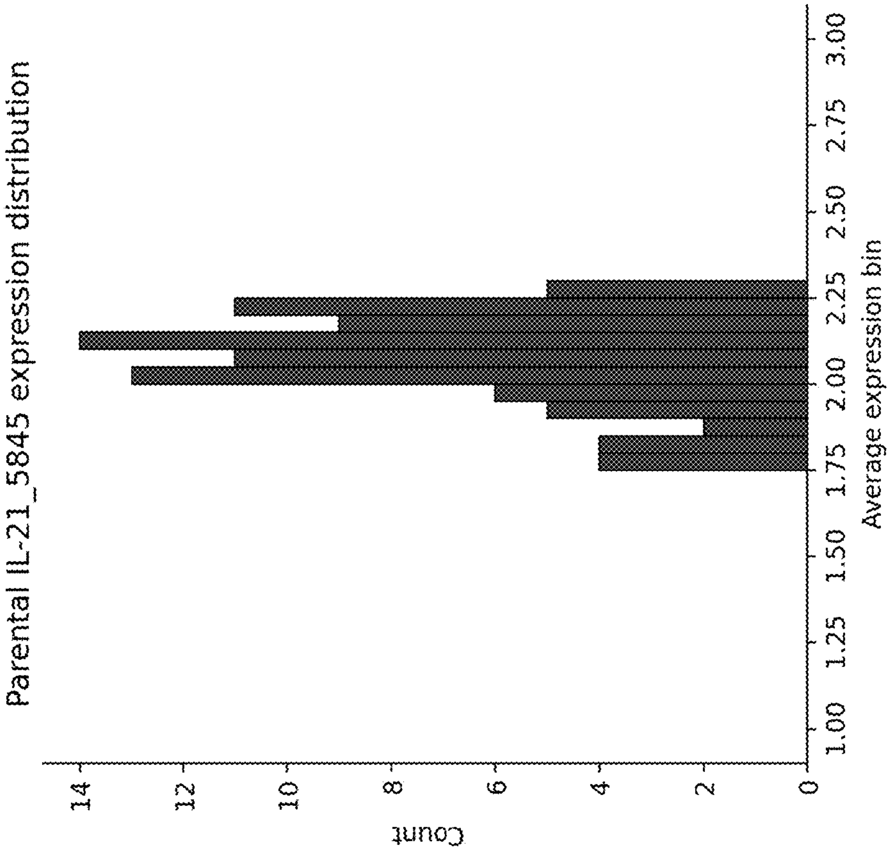
FIG. 14F is a histogram of expression values for replicates of parental human IL-21_5845. A value of 3 is the maximum possible expression in this assay and a value of 1 is the minimum possible expression.
Figure 14G:
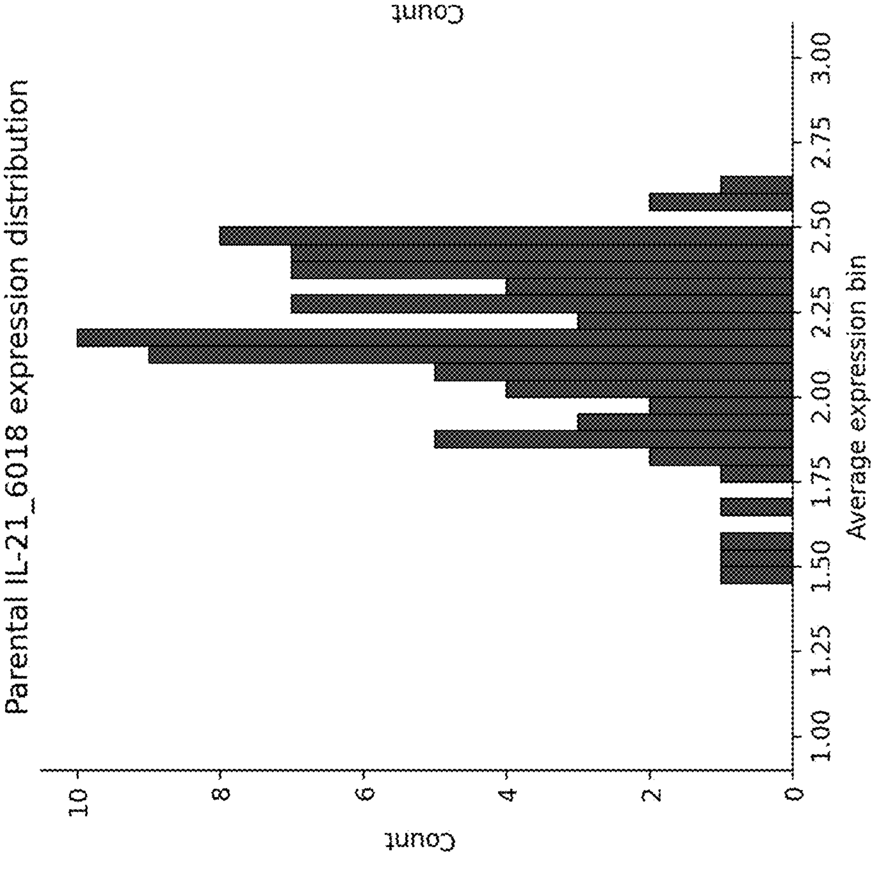
FIG. 14G is a histogram of expression values for replicates of parental human IL-21_6018. A value of 3 is the maximum possible expression in this assay and a value of 1 is the minimum possible expression.
Figure 14H:
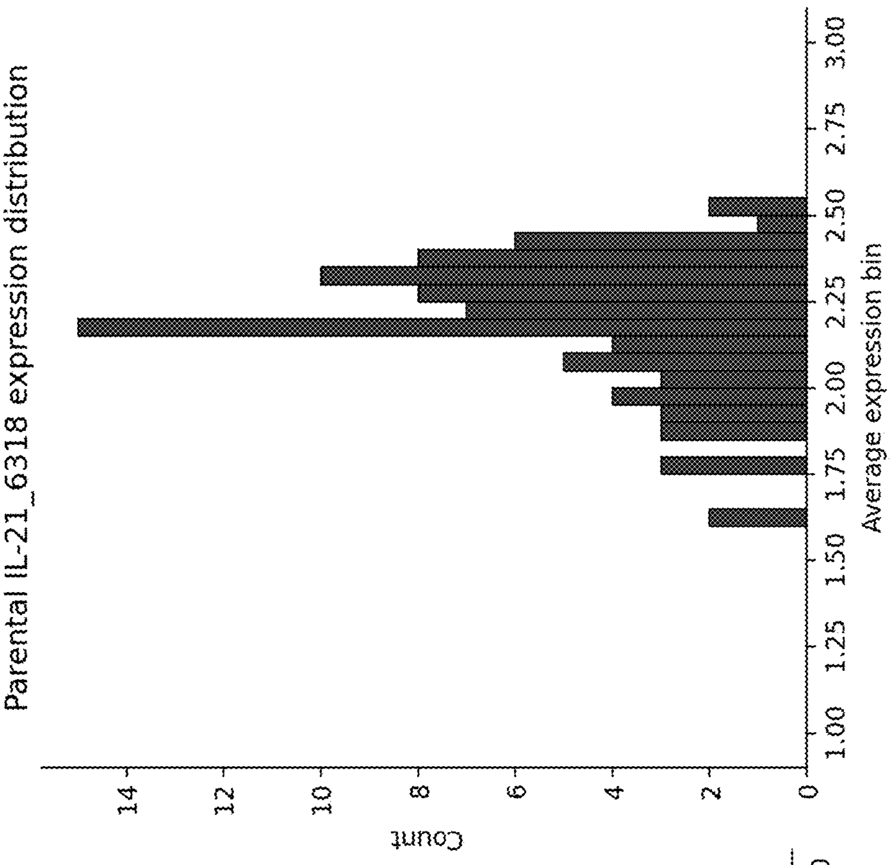
FIG. 14H is a histogram of expression values for replicates of parental human IL-21_6318. A value of 3 is the maximum possible expression in this assay and a value of 1 is the minimum possible expression.
Figure 15B:
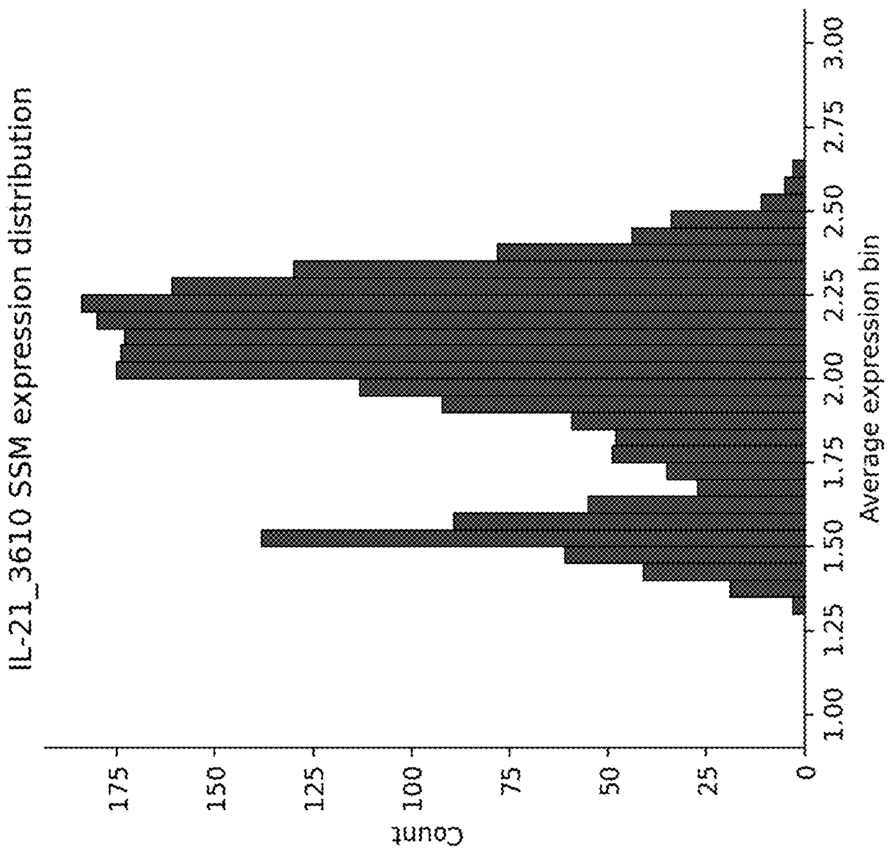
FIG. 15B is a histogram of expression values for SSM variants of of human IL-21_3610. A value of 3 is the maximum possible expression in this assay and a value of 1 is the minimum possible expression.
Figure 15A:
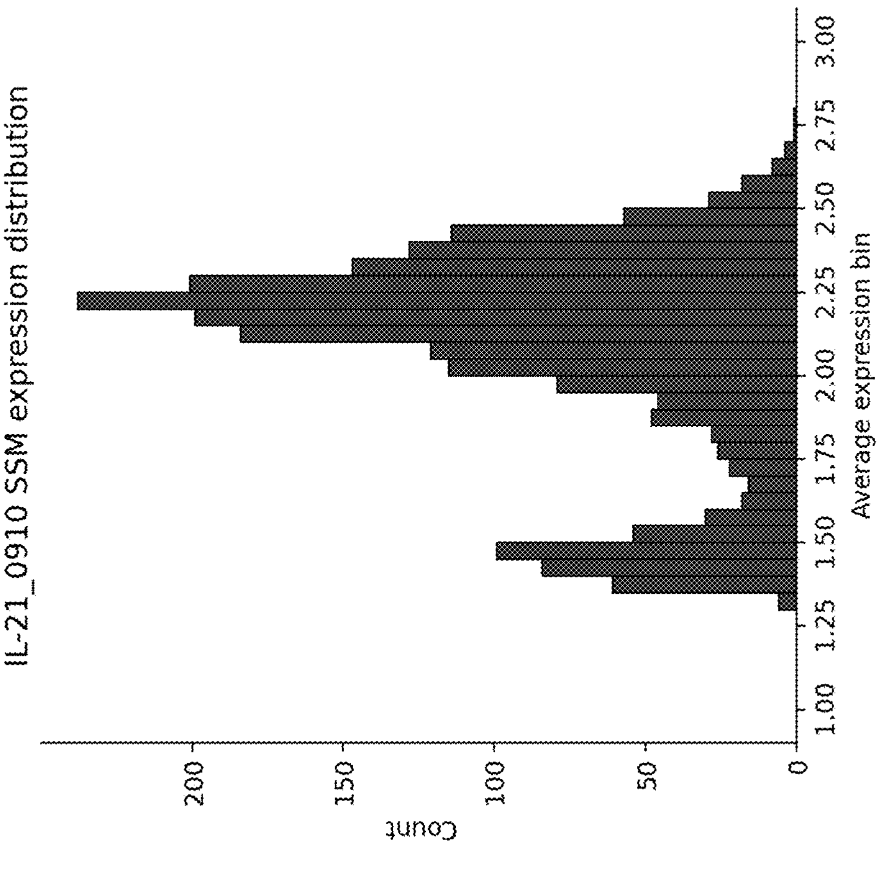
FIG. 15A is a histogram of expression values for SSM variants of human IL-21_0910. A value of 3 is the maximum possible expression in this assay and a value of 1 is the minimum possible expression.
Figure 15C:
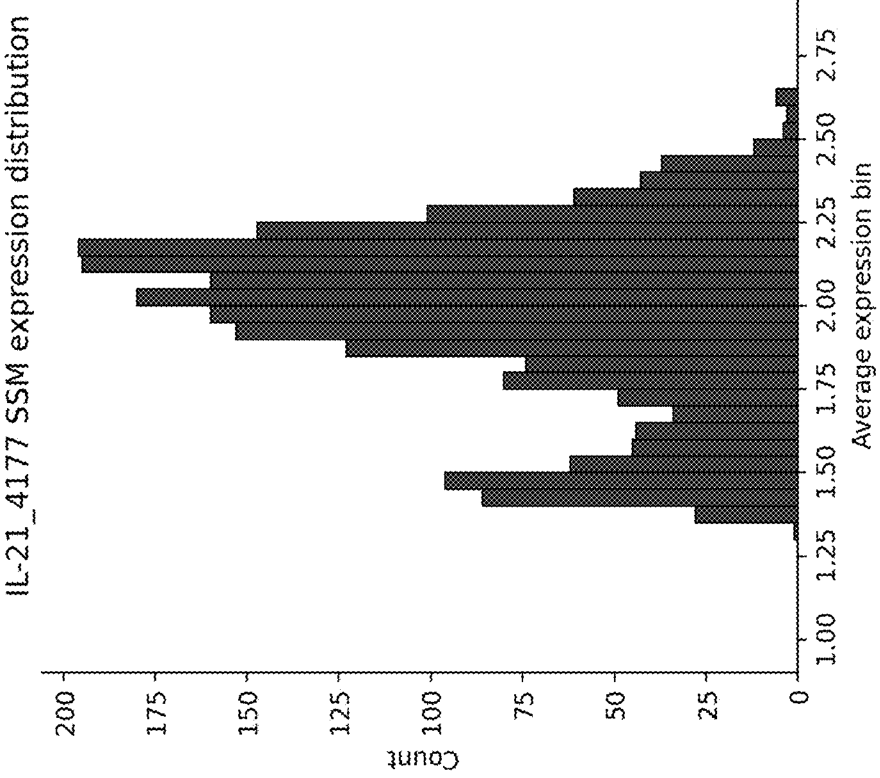
FIG. 15C is a histogram of expression values for SSM variants of human IL-21_4177. A value of 3 is the maximum possible expression in this assay and a value of 1 is the minimum possible expression.
Figure 15D:
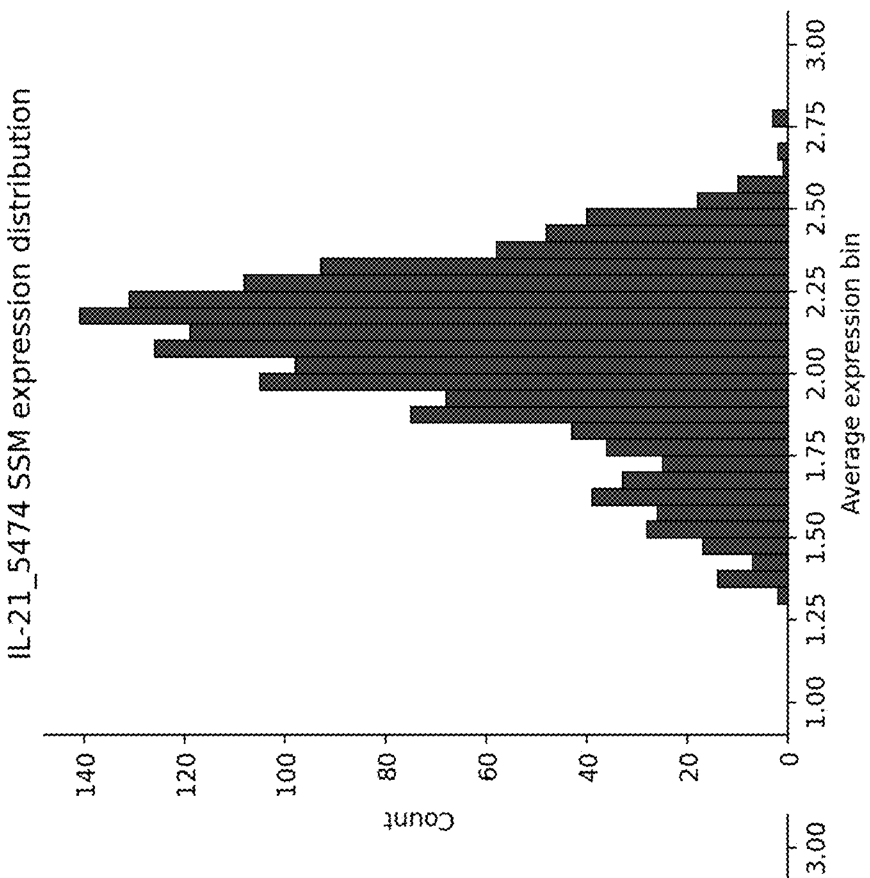
FIG. 15D is a histogram of expression values for SSM variants of human IL-21_5474. A value of 3 is the maximum possible expression in this assay and a value of 1 is the minimum possible expression.
Figure 15F:
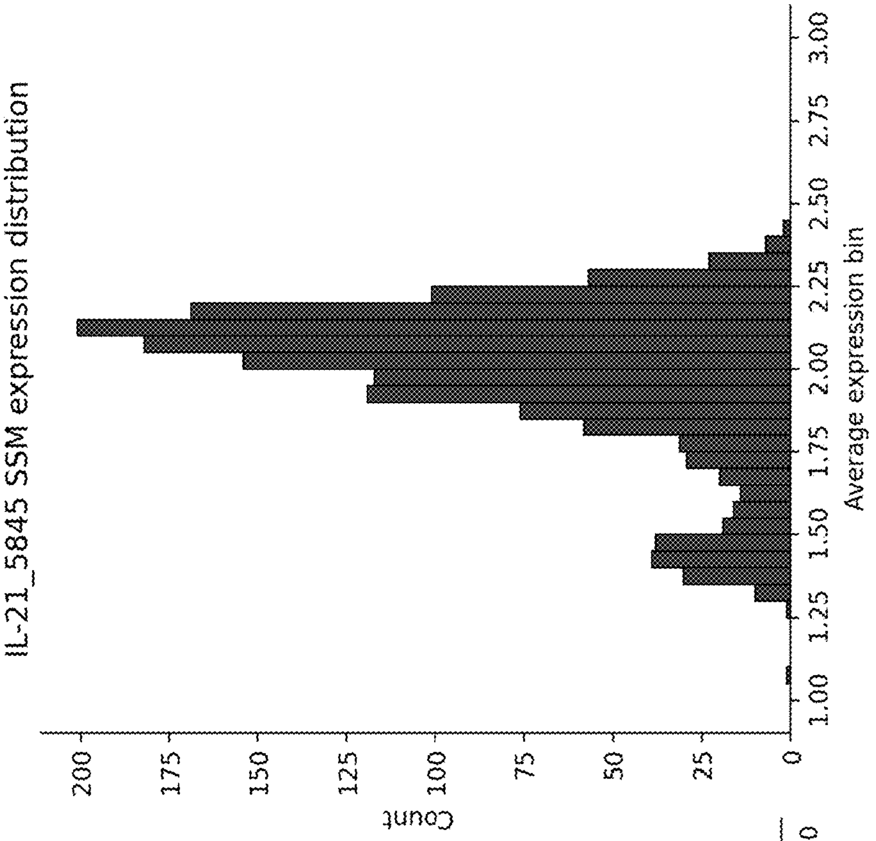
FIG. 15F is a histogram of expression values for SSM variants of human IL-21_5845. A value of 3 is the maximum possible expression in this assay and a value of 1 is the minimum possible expression.
Figure 15E:
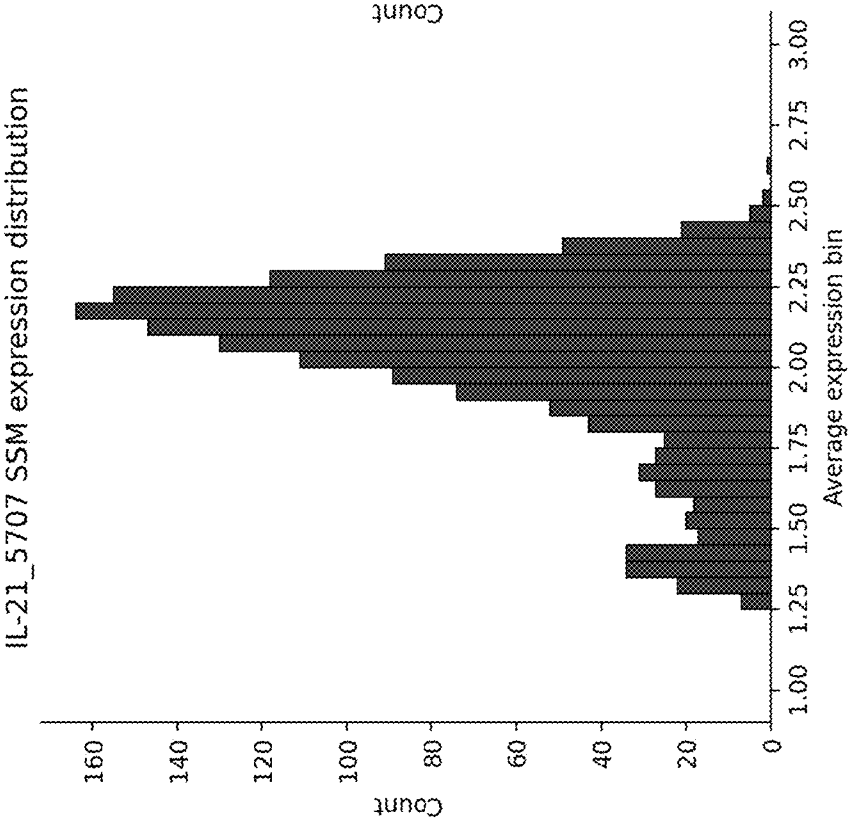
FIG. 15E is a histogram of expression values for SSM variants of human IL-21_5707. A value of 3 is the maximum possible expression in this assay and a value of 1 is the minimum possible expression.
Figure 15G:
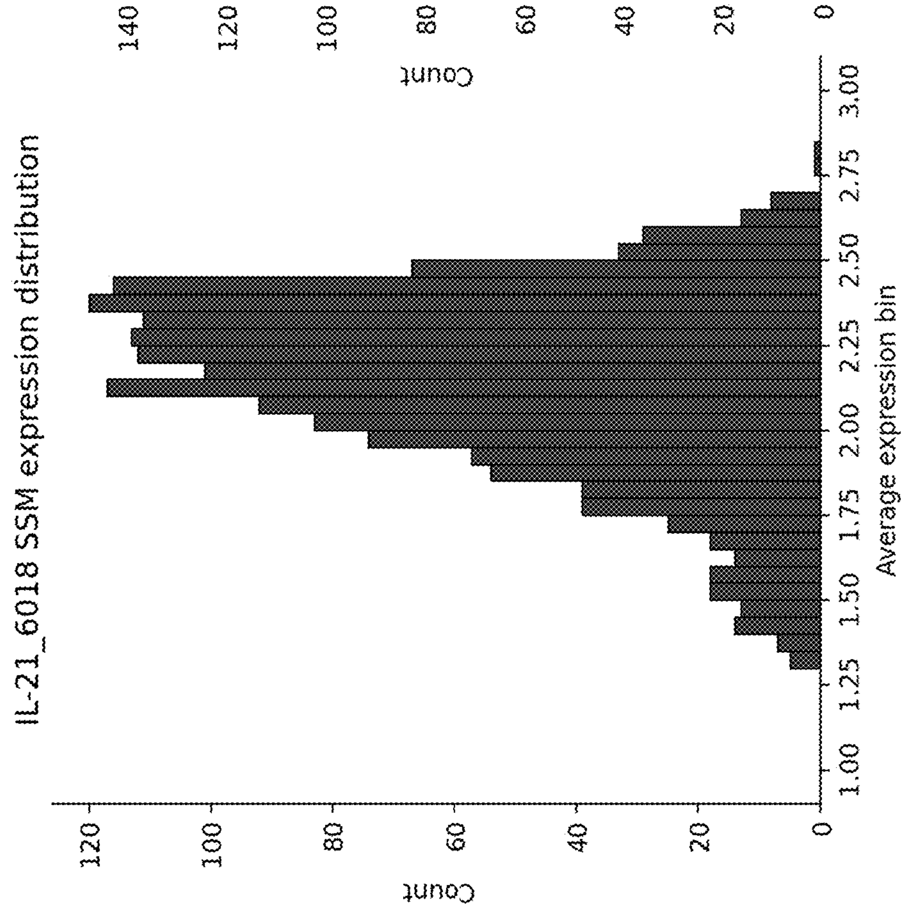
FIG. 15G is a histogram of expression values for SSM variants of human IL-21_6018. A value of 3 is the maximum possible expression in this assay and a value of 1 is the minimum possible expression.
Figure 15H:
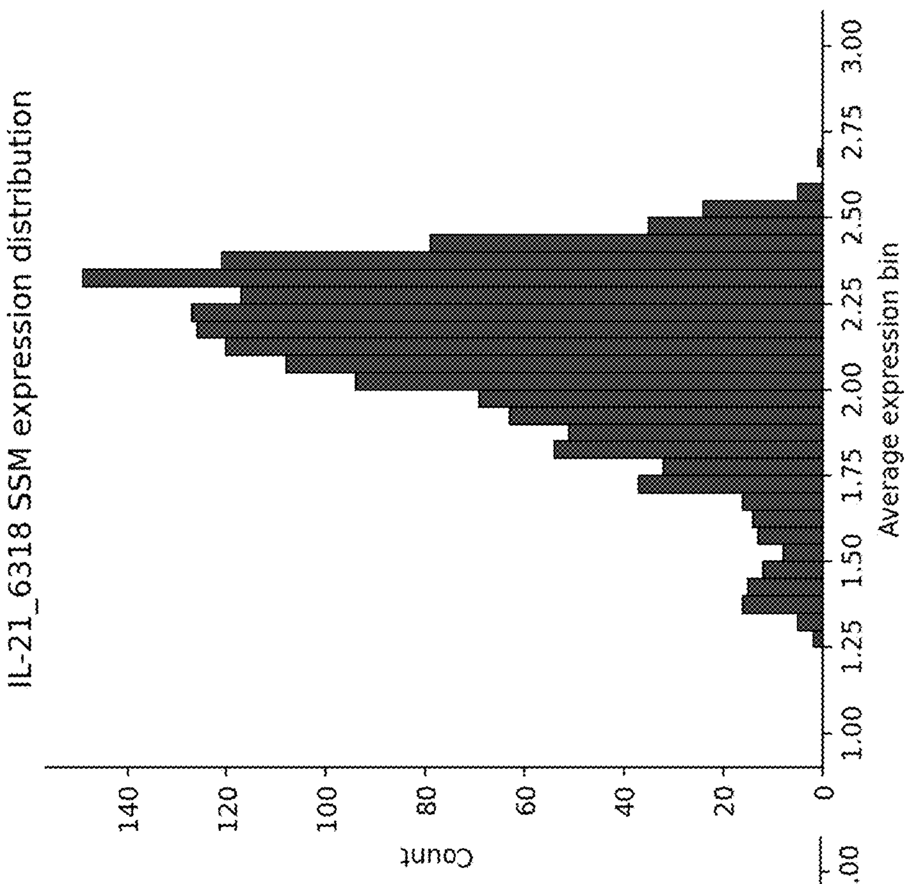
FIG. 15H is a histogram of expression values for SSM variants of human IL-21_6318. A value of 3 is the maximum possible expression in this assay and a value of 1 is the minimum possible expression.
Figure 16A:
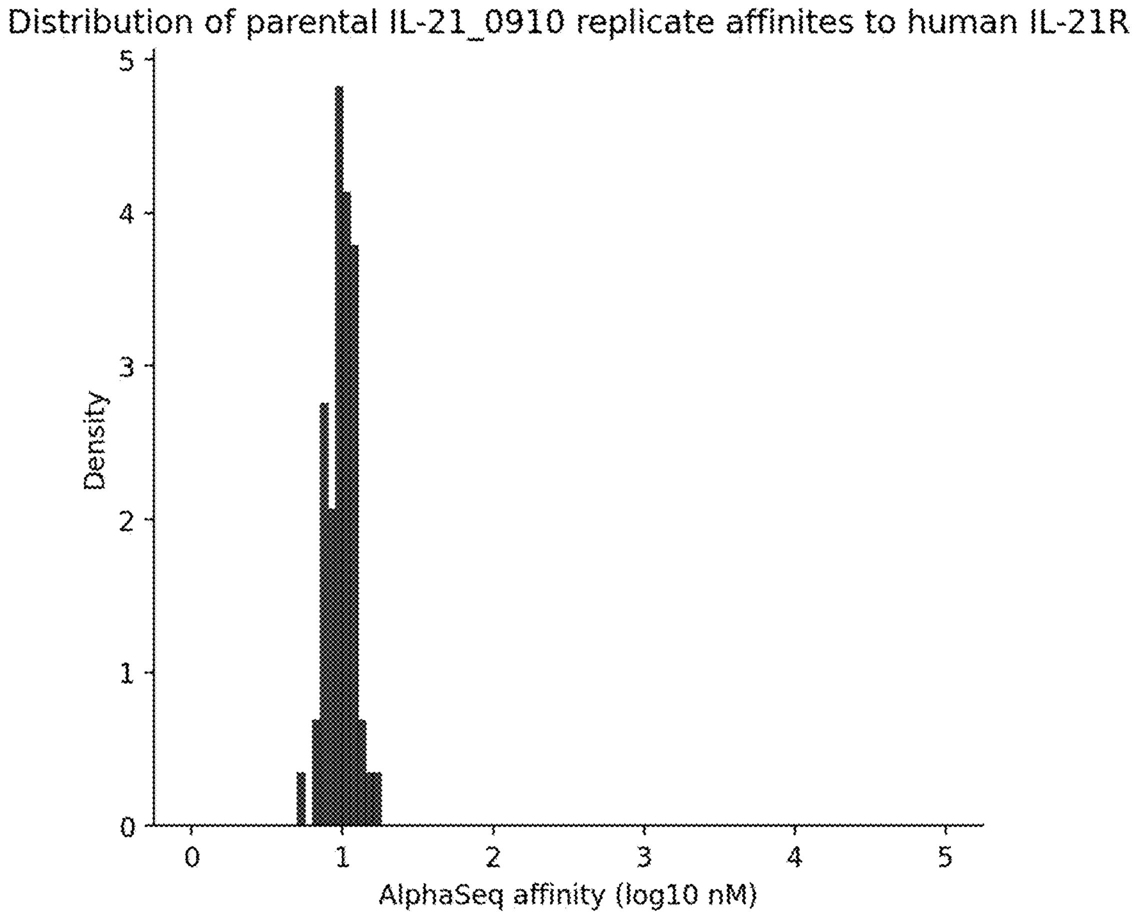
FIG. 16A is a histogram of AlphaSeq™ affinity values for the replicates of parental IL-21_0910 binding to human IL-21R in unbuffered media.
Figure 16B:
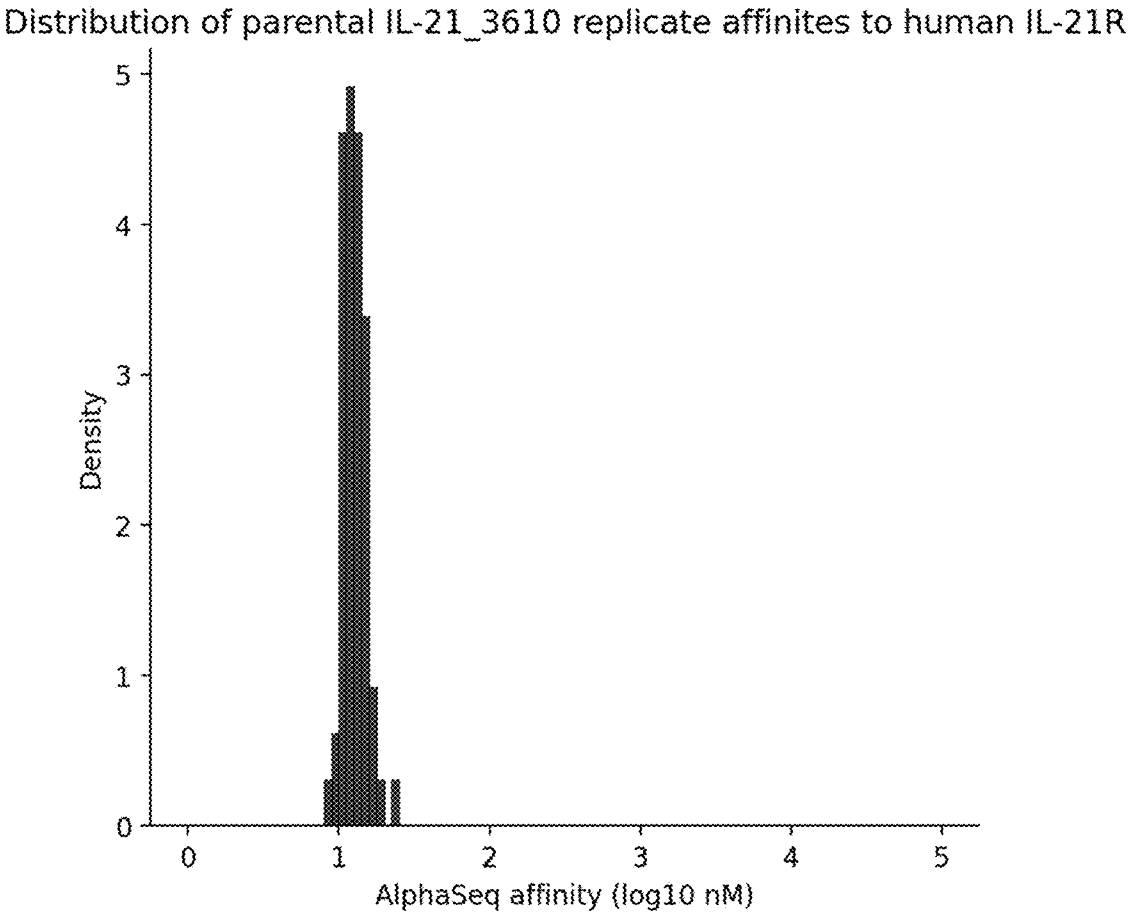
FIG. 16B is a histogram of AlphaSeq™ affinity values for the replicates of parental IL-21_3610 binding to human IL-21R in unbuffered media.
Figure 16C:
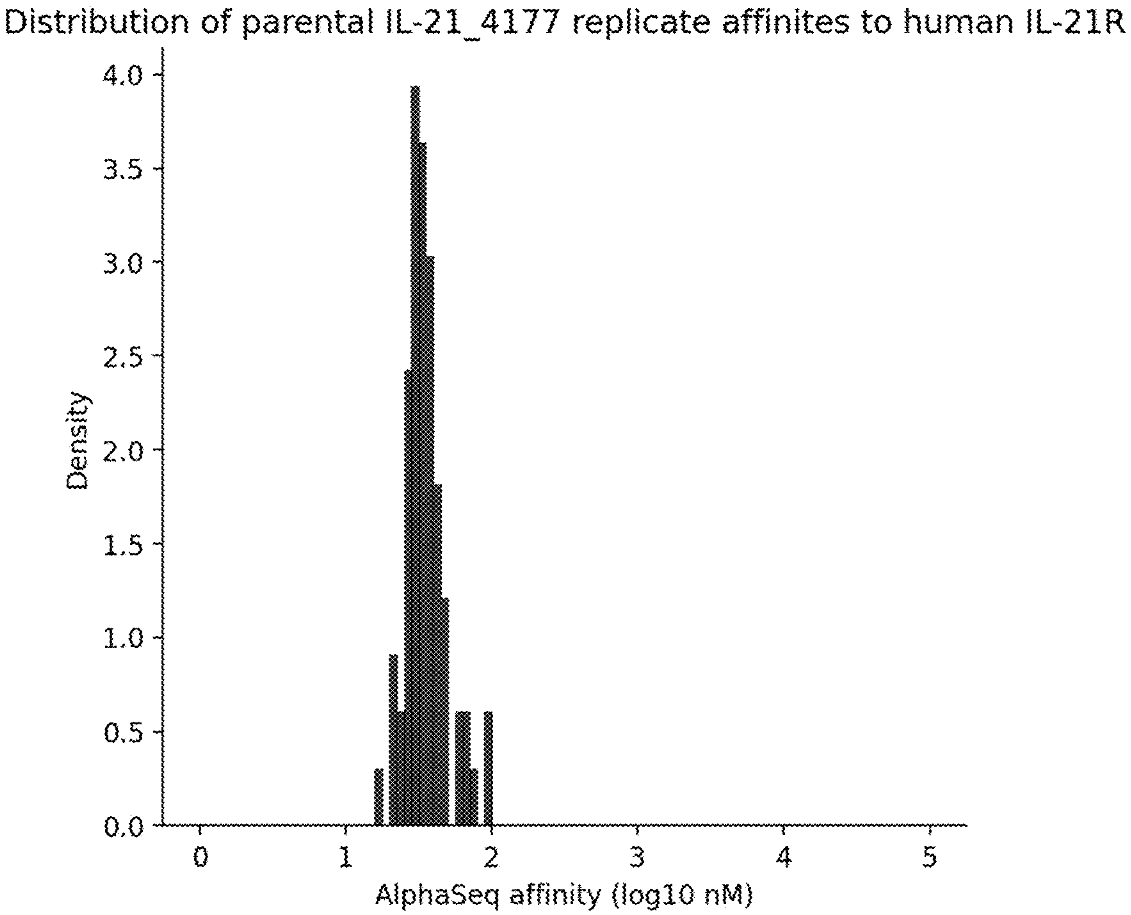
FIG. 16C is a histogram of AlphaSeq™ affinity values for the replicates of parental IL-21_4177 binding to human IL-21R in unbuffered media.
Figure 16D:
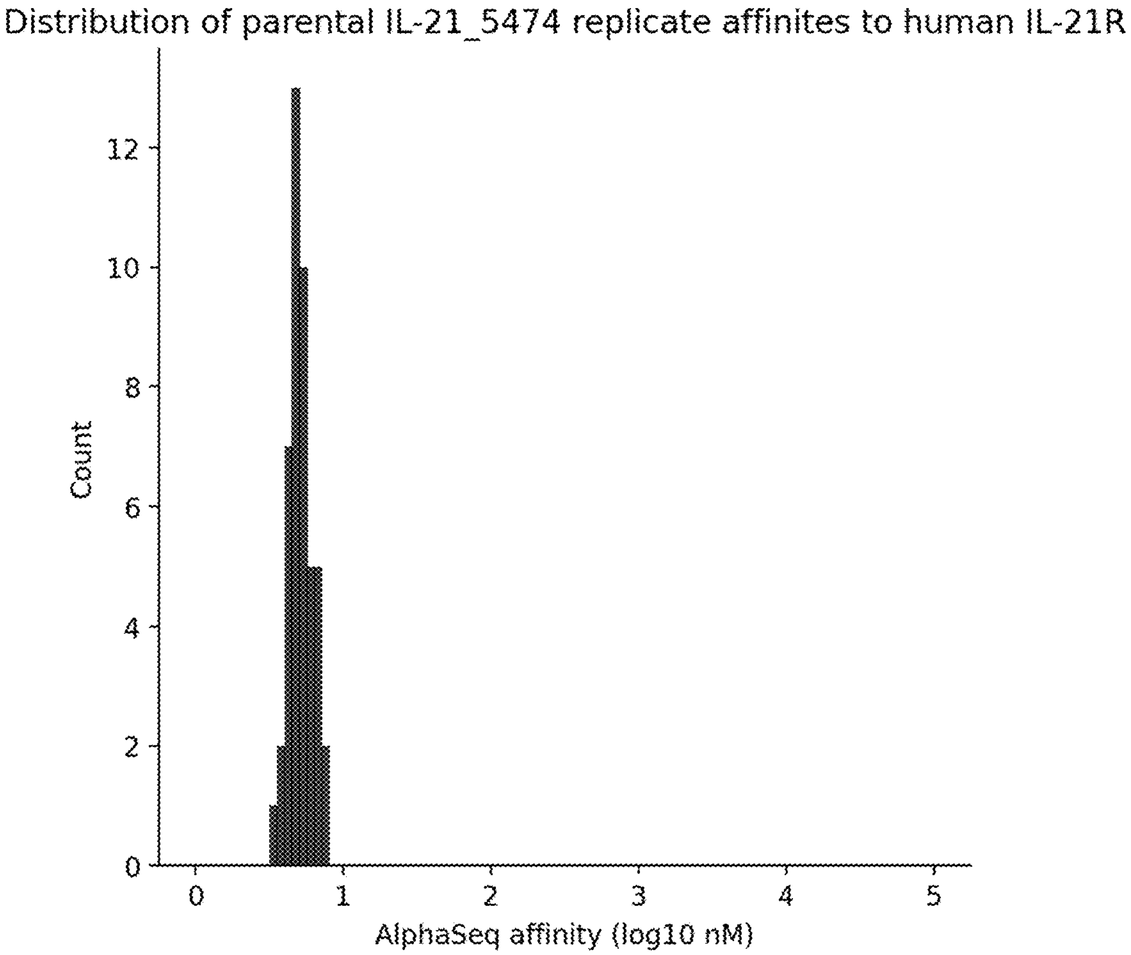
FIG. 16D is a histogram of AlphaSeq™ affinity values for the replicates of parental IL-21_5474 binding to human IL-21R in unbuffered media.
Figure 16E:
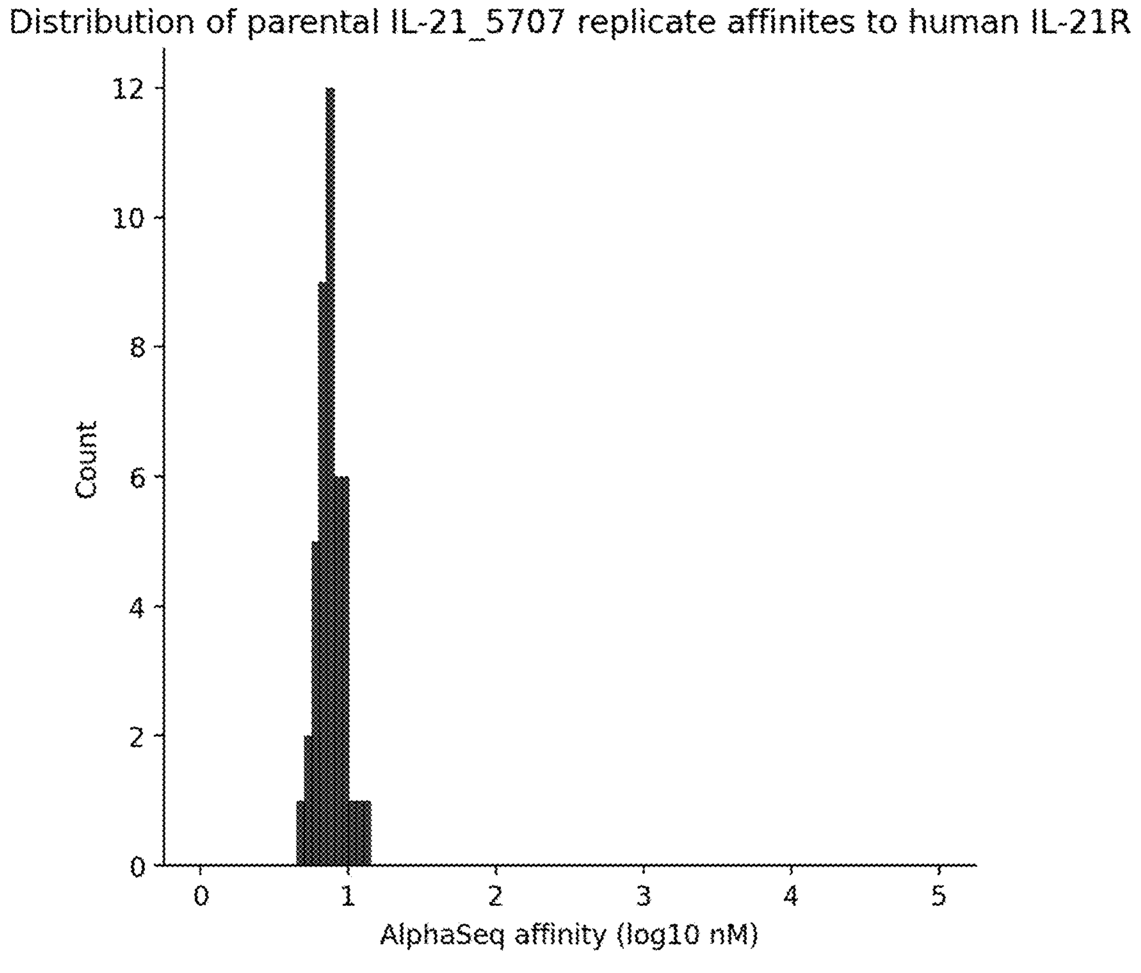
FIG. 16E is a histogram of AlphaSeq™ affinity values for the replicates of parental IL-21_5707 binding to human IL-21R in unbuffered media.
Figure 16F:
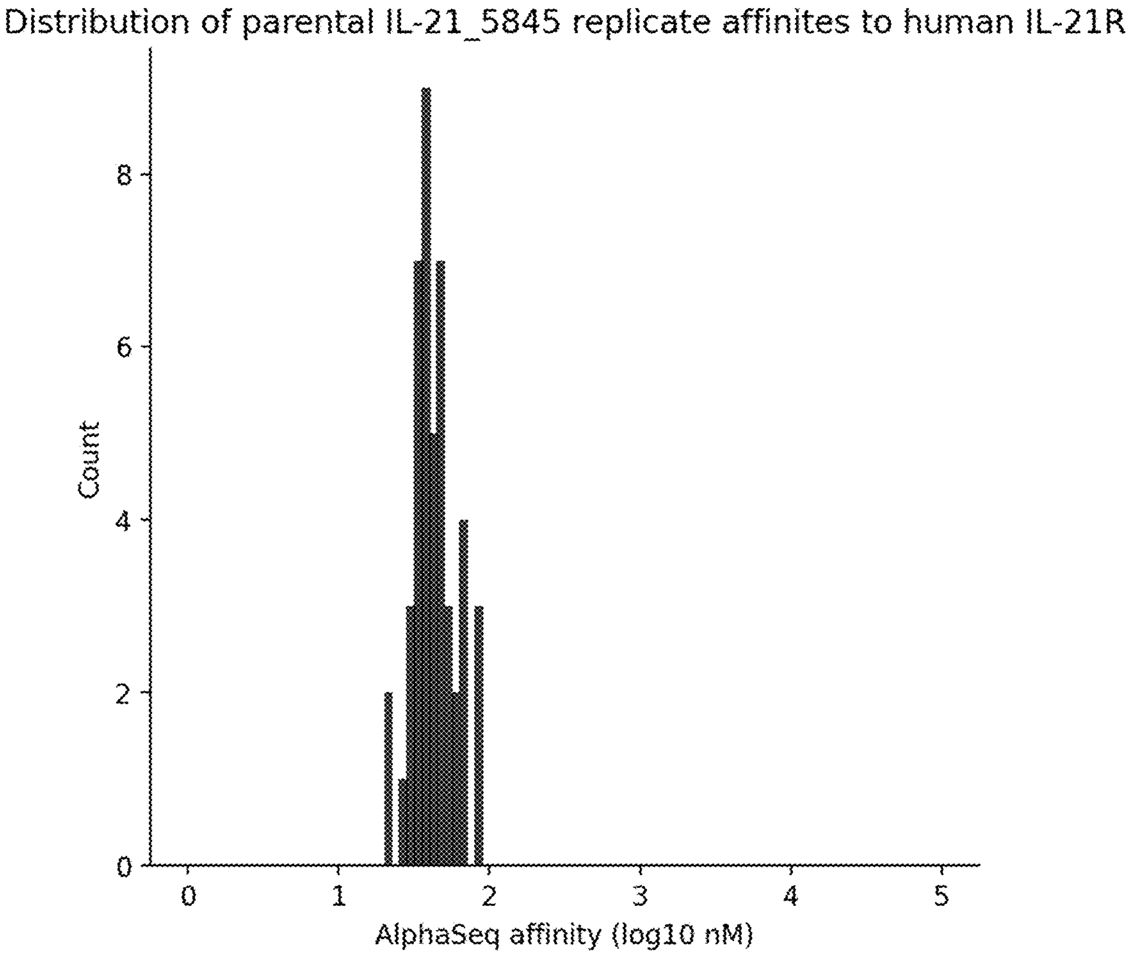
FIG. 16F is a histogram of AlphaSeq™ affinity values for the replicates of parental IL-21_5845 binding to human IL-21R in unbuffered media.
Figure 16G:
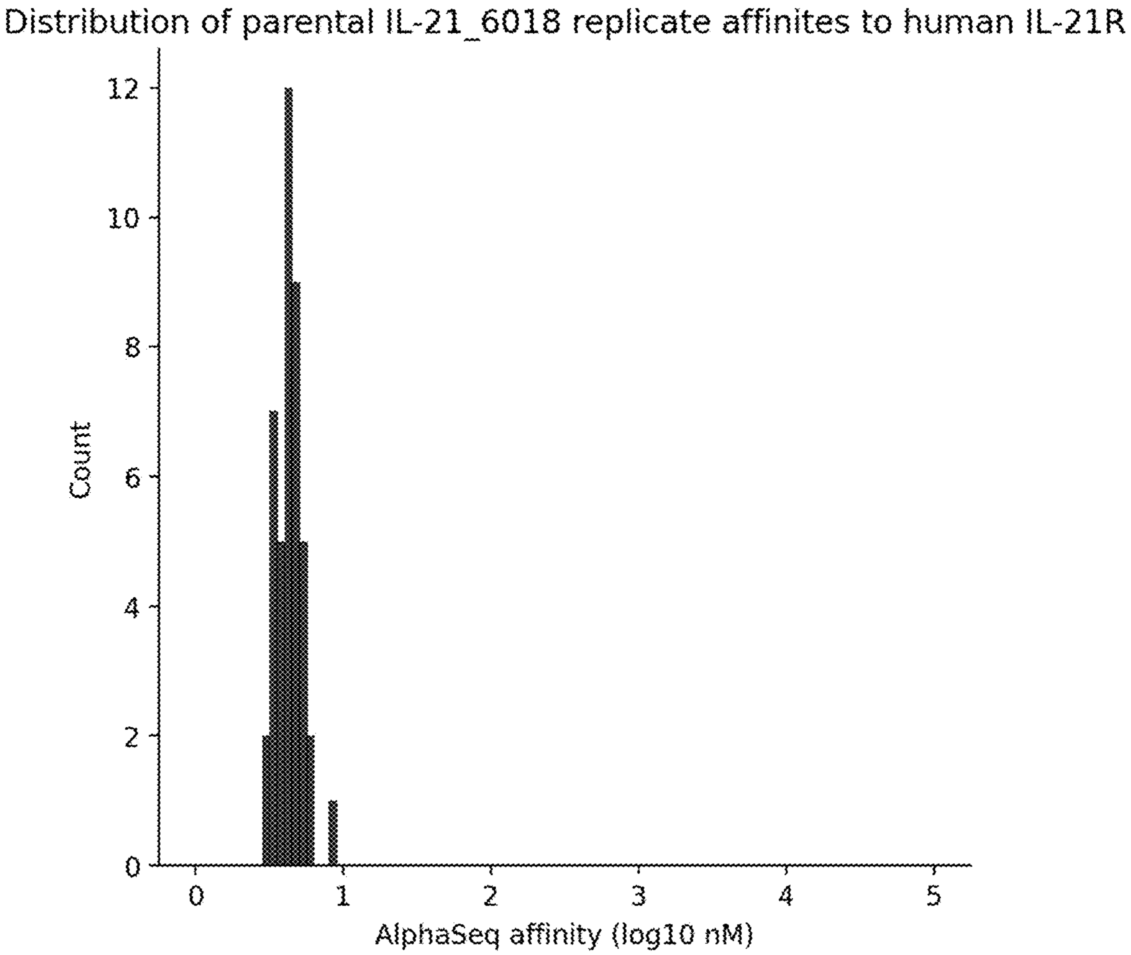
FIG. 16G is a histogram of AlphaSeq™ affinity values for the replicates of parental IL-21_6018 binding to human IL-21R in unbuffered media.
Figure 16H:
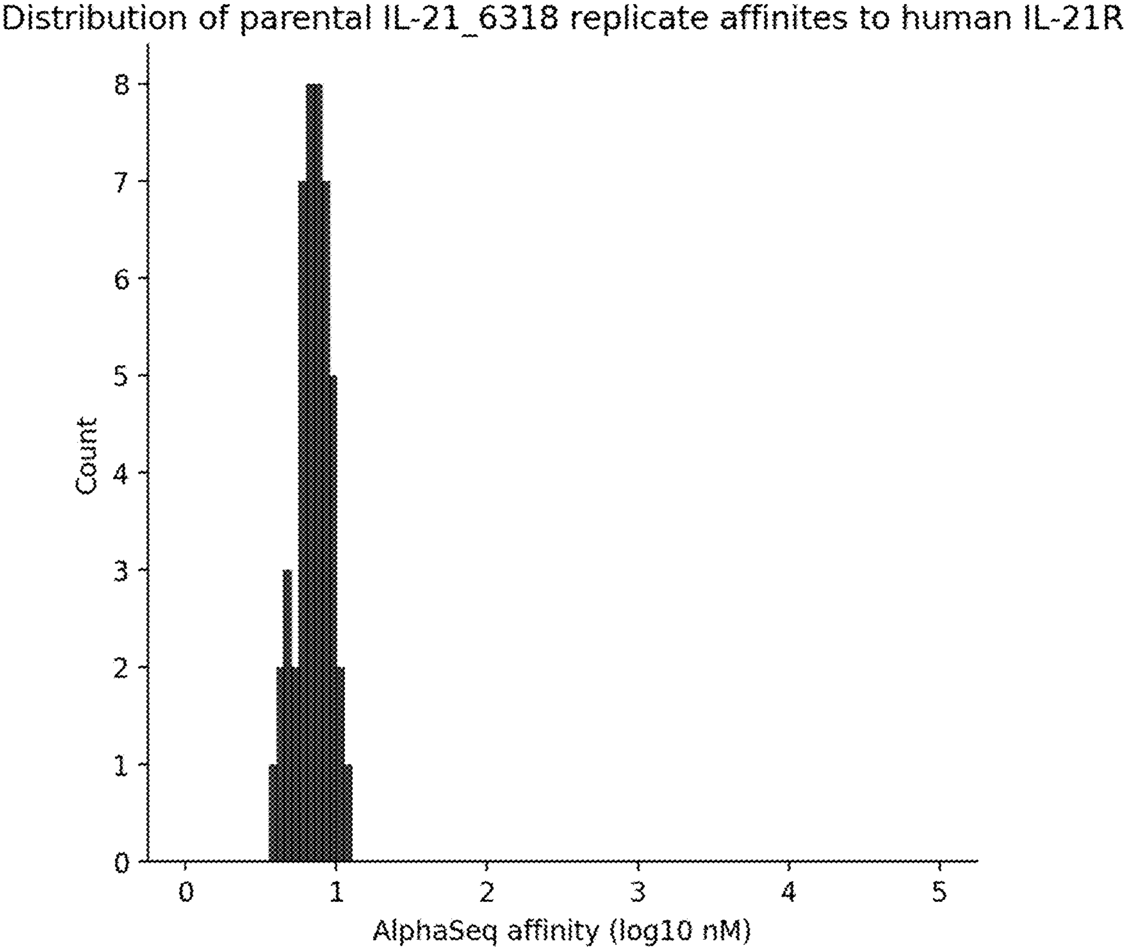
FIG. 16H is a histogram of AlphaSeq™ affinity values for the replicates of parental IL-21_6318 binding to human IL-21R in unbuffered media.
Figure 17A:
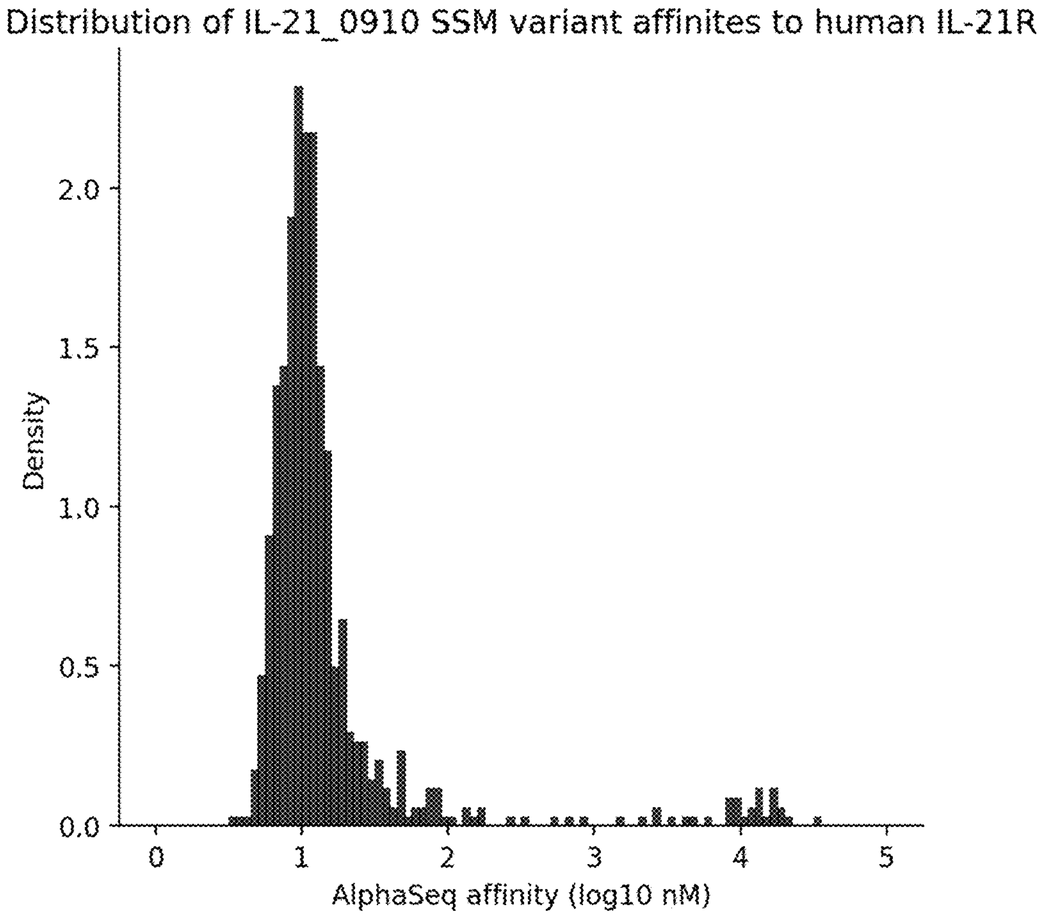
FIG. 17A is a histogram of AlphaSeq™ affinity values for the SSM variants of IL-21_0910 binding to human IL-21R in unbuffered media.
Figure 17B:
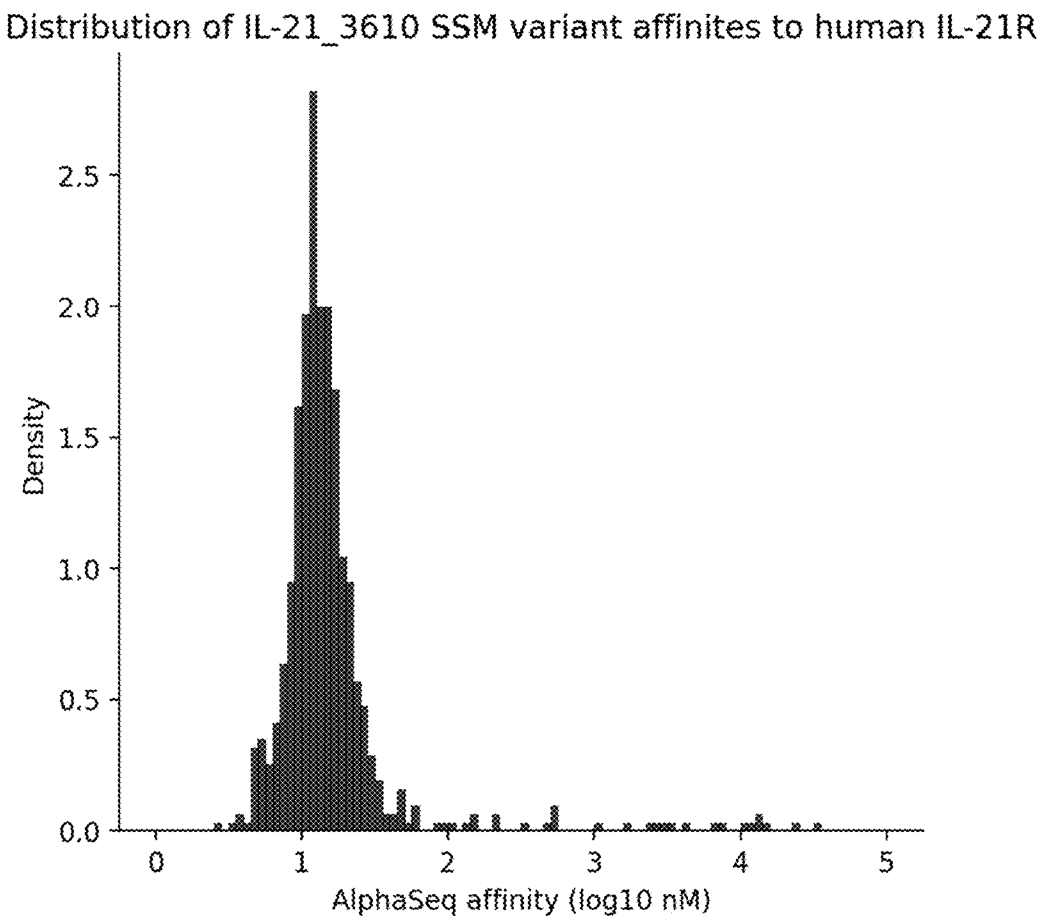
FIG. 17B is a histogram of AlphaSeq™ affinity values for the SSM variants of IL-21_3610 binding to human IL-21R in unbuffered media.
Figure 17C:
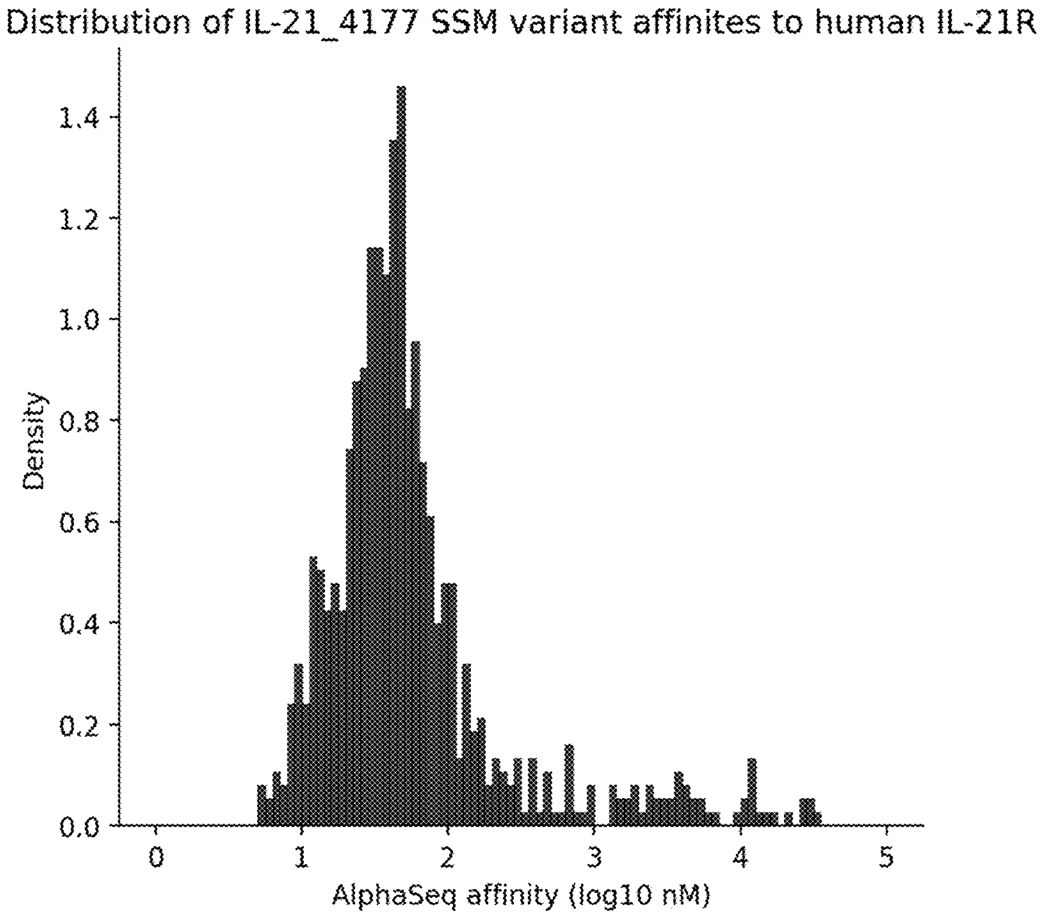
FIG. 17C is a histogram of AlphaSeq™ affinity values for the SSM variants of IL-21_4177 binding to human IL-21R in unbuffered media.
Figure 17D:
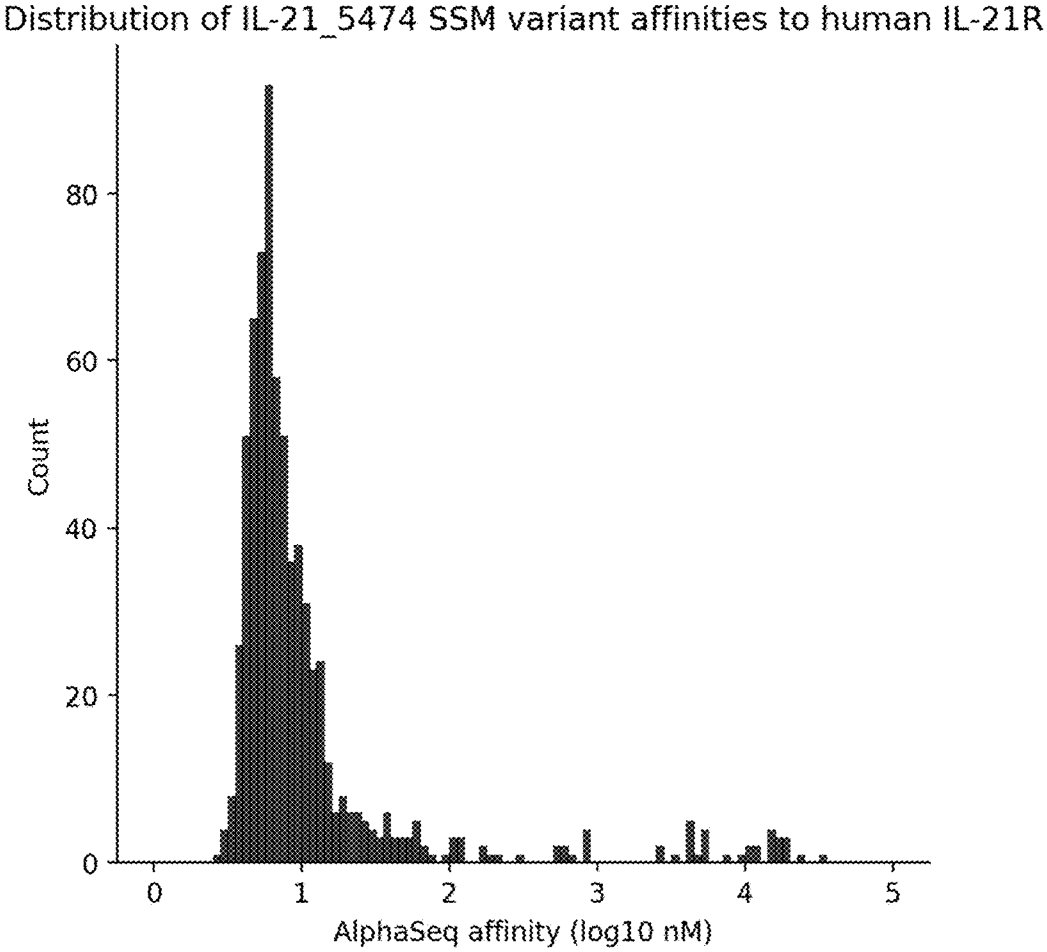
FIG. 17D is a histogram of AlphaSeq™ affinity values for the SSM variants of IL-21_5474 binding to human IL-21R in unbuffered media.
Figure 17E:
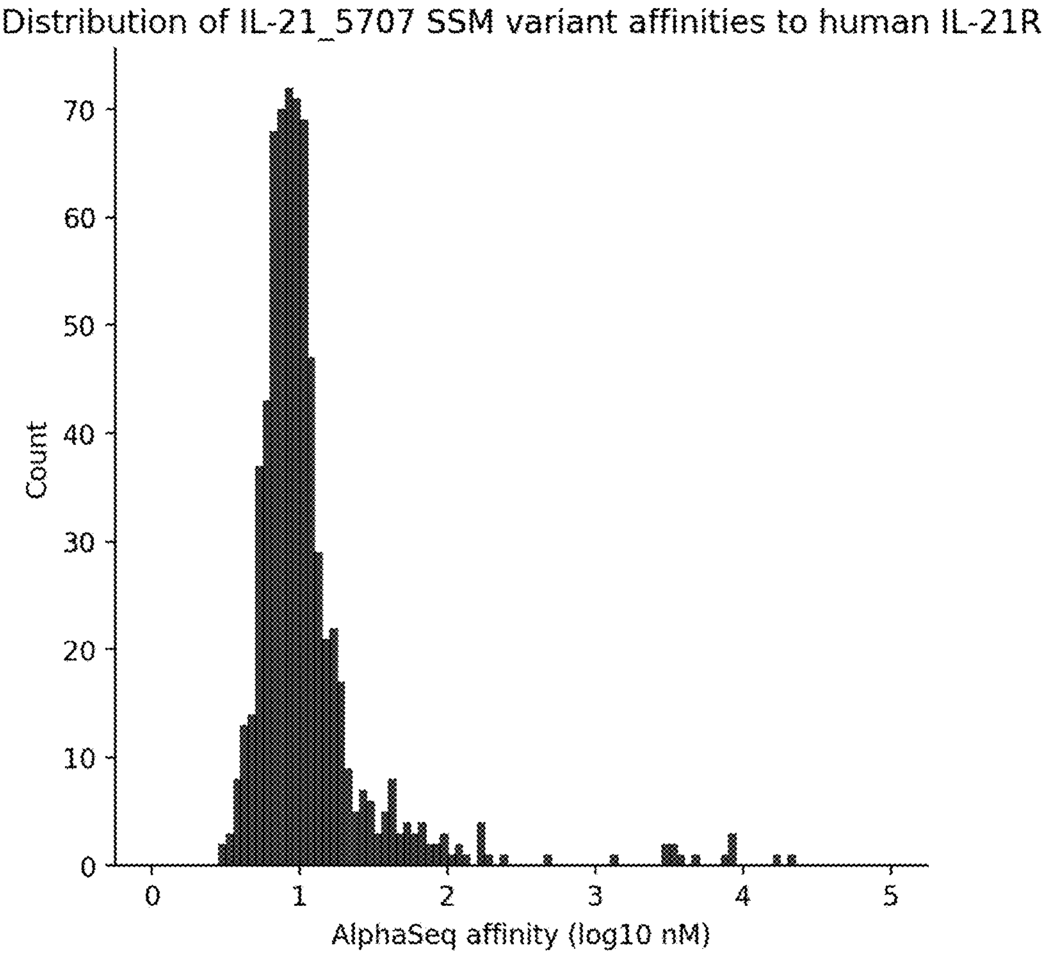
FIG. 17E is a histogram of AlphaSeq™ affinity values for the SSM variants of IL-21_5707 binding to human IL-21R in unbuffered media.
Figure 17F:
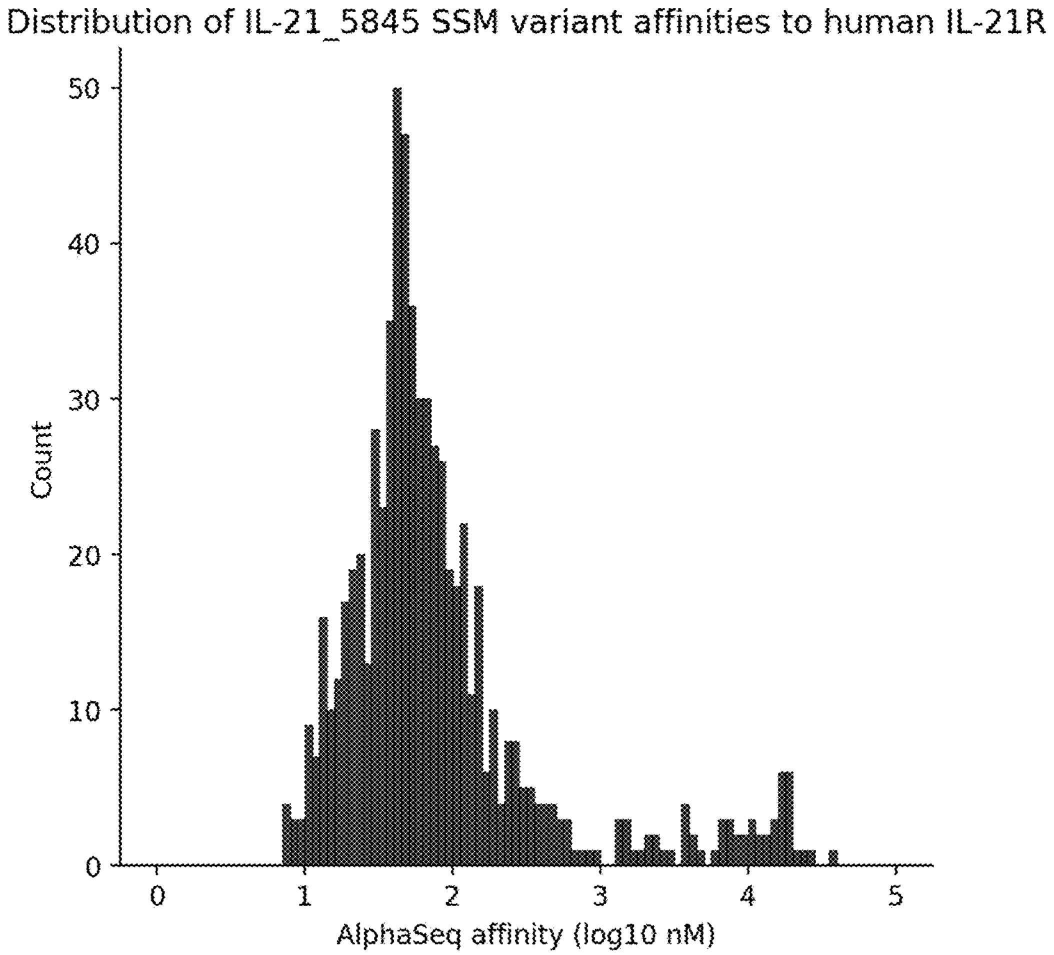
FIG. 17F is a histogram of AlphaSeq™ affinity values for the SSM variants of IL-21_5845 binding to human IL-21R in unbuffered media.
Figure 17G:
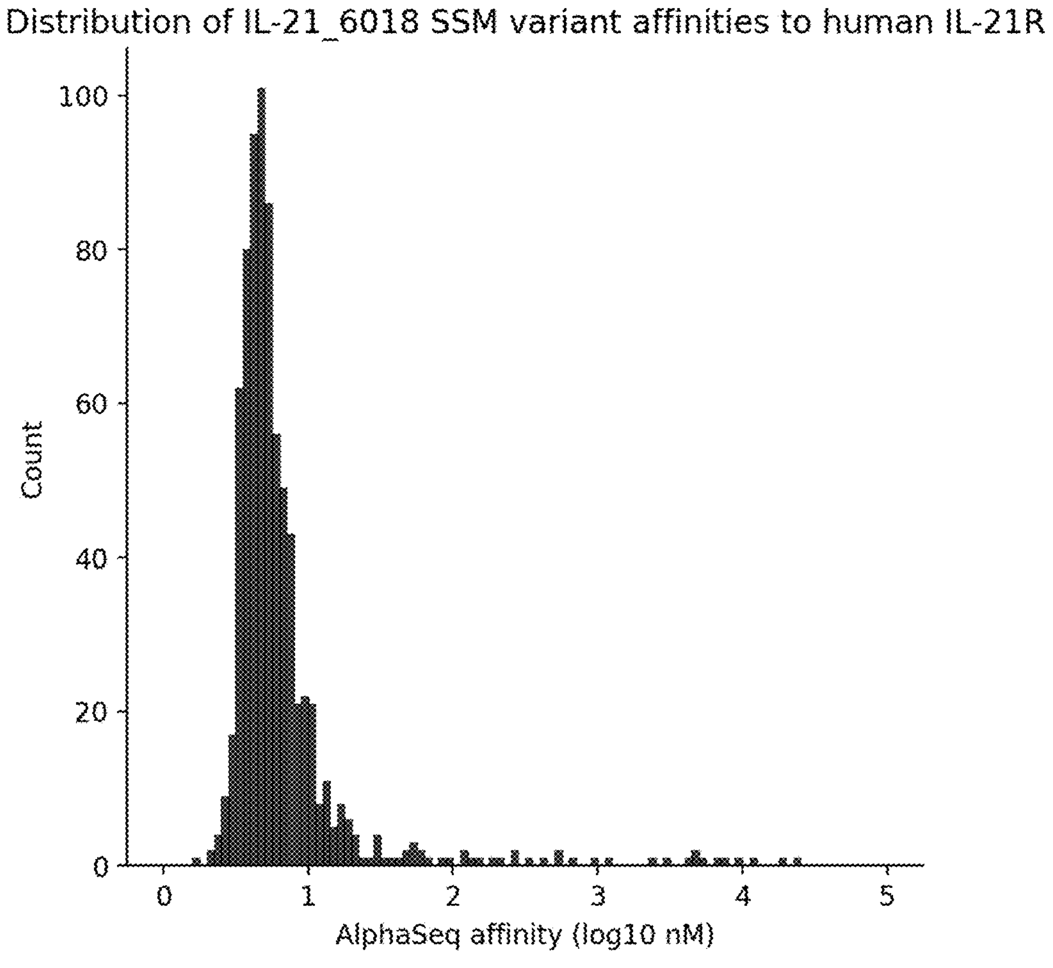
FIG. 17G is a histogram of AlphaSeq™ affinity values for the SSM variants of IL-21_6018 binding to human IL-21R in unbuffered media.
Figure 17H:
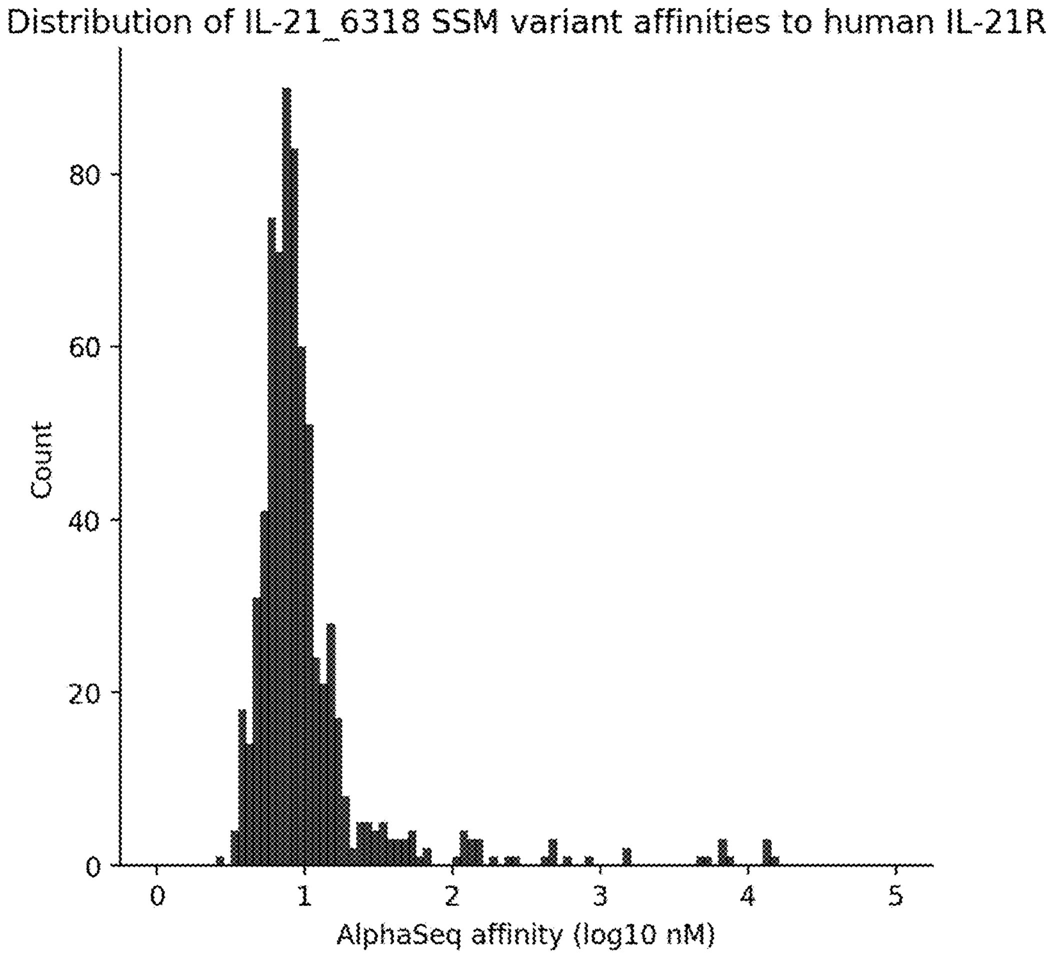
FIG. 17H is a histogram of AlphaSeq™ affinity values for the SSM variants of IL-21_6318 binding to human IL-21R in unbuffered media.

To identify further stabilized variants, a second iteration of AlphaSeq™ was performed using a library of IL-21 variants consisting of combinations of mutations identified as stabilizing in the first library (e.g., one hit from the first library, IL-21_4177, contained substitution H35I and another hit, IL-21_3610, contained substitution P107V, so the combination library tested the combination variant IL-21_H35I_P107V). Wild-type copies of IL-21 were included and showed an affinity of 1778 nM to IL-21R ($\log_{10}$ nM=3.25 in FIG. 13A). The library contained almost all stabilized variants, defining stabilized variants as those with a half-log increase in apparent binding affinity to IL-21R relative to the wild-type average (FIG. 13B). By this definition, 1513 stabilized variants were identified. These 1513 stabilized variants, combinations of mutations, predicted affinities, and amino acid sequences (SEQ ID NOs 884-2396) are provided in Table 10 below.

TABLE 8

IL-21 Single-Mutant Stabilized Variants

| Variant Name | Predicted Affinity | Amino Acid Sequence | SEQ ID NO |
|---|---|---|---|
| IL-21_ V98D | 0.875 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINDSIKKLKRKPPSTNAGRRQKHRLTCPSCDSYEKKPPKE FLERFKSLLQKMIHQHLSSRTHGSEDS | 293 |
| IL-21_ K81D | 0.945 | MRSSPGNMERIVICLMVIFLGTLVHKSSSQGQDRHMIRMRQLIDI VDQLKNYVNDLVPEFLPAPEDVETNCEWSAFSCFQDAQLKSANTG NNERIINVSIKKLKRKPPSTNAGRRQKHRLTCPSCDSYEKKPPKE FLERFKSLLQKMIHQHLSSRTHGSEDS | 294 |
| IL-21_ K101E | 0.993 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIEKLKRKPPSTNAGRRQKHRLTCPSCDSYEKKPPKE FLERFKSLLQKMIHQHLSSRTHGSEDS | 295 |
| IL-21_ R115E | 1.019 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGREQKHRLTCPSCDSYEKKPPKE FLERFKSLLQKMIHQHLSSRTHGSEDS | 296 |
| IL-21_ K81E | 1.059 | MRSSPGNMERIVICLMVIFLGTLVHKSSSQGQDRHMIRMRQLIDI VDQLKNYVNDLVPEFLPAPEDVETNCEWSAFSCFQEAQLKSANTG NNERIINVSIKKLKRKPPSTNAGRRQKHRLTCPSCDSYEKKPPKE FLERFKSLLQKMIHQHLSSRTHGSEDS | 297 |
| IL-21_ Q83E | 1.098 | MRSSPGNMERIVICLMVIFLGTLVHKSSSQGQDRHMIRMRQLIDI VDQLKNYVNDLVPEFLPAPEDVETNCEWSAFSCFQKAELKSANTG NNERIINVSIKKLKRKPPSTNAGRRQKHRLTCPSCDSYEKKPPKE FLERFKSLLQKMIHQHLSSRTHGSEDS | 298 |
| IL-21_ R94E | 1.174 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNEEIINVSIKKLKRKPPSTNAGRRQKHRLTCPSCDSYEKKPPKE FLERFKSLLQKMIHQHLSSRTHGSEDS | 299 |
| IL-21_ K101A | 1.219 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIAKLKRKPPSTNAGRRQKHRLTCPSCDSYEKKPPKE FLERFKSLLQKMIHQHLSSRTHGSEDS | 300 |
| IL-21_ K101D | 1.238 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIDKLKRKPPSTNAGRRQKHRLTCPSCDSYEKKPPKE FLERFKSLLQKMIHQHLSSRTHGSEDS | 301 |
| IL-21_ R94D | 1.281 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNEDIINVSIKKLKRKPPSTNAGRRQKHRLTCPSCDSYEKKPPKE FLERFKSLLQKMIHQHLSSRTHGSEDS | 302 |
| IL-21_ H35D | 1.283 | MRSSPGNMERIVICLMVIFLGTLVHKSSSQGQDRDMIRMRQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 303 |
| IL-21_ K102Q | 1.296 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKQLKRKPPSTNAGRRQKHRLTCPSCDSYEKKPPKE FLERFKSLLQKMIHQHLSSRTHGSEDS | 304 |
| IL-21_ K81N | 1.299 | MRSSPGNMERIVICLMVIFLGTLVHKSSSQGQDRHMIRMRQLIDI VDQLKNYVNDLVPEFLPAPEDVETNCEWSAFSCFQNAQLKSANTG NNERIINVSIKKLKRKPPSTNAGRRQKHRLTCPSCDSYEKKPPKE FLERFKSLLQKMIHQHLSSRTHGSEDS | 305 |
| IL-21_ H35E | 1.304 | MRSSPGNMERIVICLMVIFLGTLVHKSSSQGQDREMIRMRQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 306 |
| IL-21_ V98E | 1.335 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINESIKKLKRKPPSTNAGRRQKHRLTCPSCDSYEKKPPKE FLERFKSLLQKMIHQHLSSRTHGSEDS | 307 |

TABLE 8-continued

| IL-21 Single-Mutant Stabilized Variants | | | |
|---|---|---|---|
| Variant Name | Predicted Affinity | Amino Acid Sequence | SEQ ID NO |
| IL-21_ R119E | 1.362 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQKHELTCPSCDSYEKKPPKE FLERFKSLLQKMIHQHLSSRTHGSEDS | 308 |
| IL-21_ R114D | 1.368 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGDRQKHRLTCPSCDSYEKKPPKE FLERFKSLLQKMIHQHLSSRTHGSEDS | 309 |
| IL-21_ K81S | 1.443 | MRSSPGNMERIVICLMVIFLGTLVHKSSSQGQDRHMIRMRQLIDI VDQLKNYVNDLVPEFLPAPEDVETNCEWSAFSCFQSAQLKSANTG NNERIINVSIKKLKRKPPSTNAGRRQKHRLTCPSCDSYEKKPPKE FLERFKSLLQKMIHQHLSSRTHGSEDS | 310 |
| IL-21_ K117E | 1.45 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQEHRLTCPSCDSYEKKPPKE FLERFKSLLQKMIHQHLSSRTHGSEDS | 311 |
| IL-21_ R114P | 1.503 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGPRQKHRLTCPSCDSYEKKPPKE FLERFKSLLQKMIHQHLSSRTHGSEDS | 312 |
| IL-21_ K106I | 1.51 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRIPPSTNAGRRQKHRLTCPSCDSYEKKPPKE FLERFKSLLQKMIHQHLSSRTHGSEDS | 313 |
| IL-21_ R114Q | 1.52 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGQRQKHRLTCPSCDSYEKKPPKE FLERFKSLLQKMIHQHLSSRTHGSEDS | 314 |
| IL-21_ K81M | 1.537 | MRSSPGNMERIVICLMVIFLGTLVHKSSSQGQDRHMIRMRQLIDI VDQLKNYVNDLVPEFLPAPEDVETNCEWSAFSCFQMAQLKSANTG NNERIINVSIKKLKRKPPSTNAGRRQKHRLTCPSCDSYEKKPPKE FLERFKSLLQKMIHQHLSSRTHGSEDS | 315 |
| IL-21_ R114L | 1.552 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGLRQKHRLTCPSCDSYEKKPPKE FLERFKSLLQKMIHQHLSSRTHGSEDS | 316 |
| IL-21_ R119D | 1.565 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQKHDLTCPSCDSYEKKPPKE FLERFKSLLQKMIHQHLSSRTHGSEDS | 317 |
| IL-21_ R94A | 1.565 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNEAIINVSIKKLKRKPPSTNAGRRQKHRLTCPSCDSYEKKPPKE FLERFKSLLQKMIHQHLSSRTHGSEDS | 318 |
| IL-21_ K81T | 1.592 | MRSSPGNMERIVICLMVIFLGTLVHKSSSQGQDRHMIRMRQLIDI VDQLKNYVNDLVPEFLPAPEDVETNCEWSAFSCFQTAQLKSANTG NNERIINVSIKKLKRKPPSTNAGRRQKHRLTCPSCDSYEKKPPKE FLERFKSLLQKMIHQHLSSRTHGSEDS | 319 |
| IL-21_ H118D | 1.595 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQKDRLTCPSCDSYEKKPPKE FLERFKSLLQKMIHQHLSSRTHGSEDS | 320 |
| IL-21_ K81G | 1.596 | MRSSPGNMERIVICLMVIFLGTLVHKSSSQGQDRHMIRMRQLIDI VDQLKNYVNDLVPEFLPAPEDVETNCEWSAFSCFQGAQLKSANTG NNERIINVSIKKLKRKPPSTNAGRRQKHRLTCPSCDSYEKKPPKE FLERFKSLLQKMIHQHLSSRTHGSEDS | 321 |

TABLE 8-continued

IL-21 Single-Mutant Stabilized Variants

| Variant Name | Predicted Affinity | Amino Acid Sequence | SEQ ID NO |
|---|---|---|---|
| IL-21_ K104L | 1.598 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLLRKPPSTNAGRRQKHRLTCPSCDSYEKKPPKE FLERFKSLLQKMIHQHLSSRTHGSEDS | 322 |
| IL-21_ H35Y | 1.607 | MRSSPGNMERIVICLMVIFLGTLVHKSSSQGQDRYMIRMRQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 323 |
| IL-21_ H35W | 1.61 | MRSSPGNMERIVICLMVIFLGTLVHKSSSQGQDRWMIRMRQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 324 |
| IL-21_ R115D | 1.631 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRDQKHRLTCPSCDSYEKKPPKE FLERFKSLLQKMIHQHLSSRTHGSEDS | 325 |
| IL-21_ H118E | 1.639 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQKERLTCPSCDSYEKKPPKE FLERFKSLLQKMIHQHLSSRTHGSEDS | 326 |
| IL-21_ K81A | 1.66 | MRSSPGNMERIVICLMVIFLGTLVHKSSSQGQDRHMIRMRQLIDI VDQLKNYVNDLVPEFLPAPEDVETNCEWSAFSCFQAAQLKSANTG NNERIINVSIKKLKRKPPSTNAGRRQKHRLTCPSCDSYEKKPPKE FLERFKSLLQKMIHQHLSSRTHGSEDS | 327 |
| IL-21_ S77E | 1.667 | MRSSPGNMERIVICLMVIFLGTLVHKSSSQGQDRHMIRMRQLIDI VDQLKNYVNDLVPEFLPAPEDVETNCEWSAFECFQKAQLKSANTG NNERIINVSIKKLKRKPPSTNAGRRQKHRLTCPSCDSYEKKPPKE FLERFKSLLQKMIHQHLSSRTHGSEDS | 328 |
| IL-21_ K106Y | 1.686 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRYPPSTNAGRRQKHRLTCPSCDSYEKKPPKE FLERFKSLLQKMIHQHLSSRTHGSEDS | 329 |
| IL-21_ K117D | 1.686 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQDHRLTCPSCDSYEKKPPKE FLERFKSLLQKMIHQHLSSRTHGSEDS | 330 |
| IL-21_ K101S | 1.688 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSISKLKRKPPSTNAGRRQKHRLTCPSCDSYEKKPPKE FLERFKSLLQKMIHQHLSSRTHGSEDS | 331 |
| IL-21_ K102G | 1.709 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKGLKRKPPSTNAGRRQKHRLTCPSCDSYEKKPPKE FLERFKSLLQKMIHQHLSSRTHGSEDS | 332 |
| IL-21_ R114I | 1.716 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGIRQKHRLTCPSCDSYEKKPPKE FLERFKSLLQKMIHQHLSSRTHGSEDS | 333 |
| IL-21_ K102E | 1.723 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKELKRKPPSTNAGRRQKHRLTCPSCDSYEKKPPKE FLERFKSLLQKMIHQHLSSRTHGSEDS | 334 |
| IL-21_ K106V | 1.735 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRVPPSTNAGRRQKHRLTCPSCDSYEKKPPKE FLERFKSLLQKMIHQHLSSRTHGSEDS | 335 |

TABLE 8-continued

IL-21 Single-Mutant Stabilized Variants

| Variant Name | Predicted Affinity | Amino Acid Sequence | SEQ ID NO |
|---|---|---|---|
| IL-21_ K102A | 1.741 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKALKRKPPSTNAGRRQKHRLTCPSCDSYEKKPPKE FLERFKSLLQKMIHQHLSSRTHGSEDS | 336 |
| IL-21_ R115P | 1.742 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRPQKHRLTCPSCDSYEKKPPKE FLERFKSLLQKMIHQHLSSRTHGSEDS | 337 |
| IL-21_ T110D | 1.747 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSDNAGRRQKHRLTCPSCDSYEKKPPKE FLERFKSLLQKMIHQHLSSRTHGSEDS | 338 |
| IL-21_ R115N | 1.76 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRNQKHRLTCPSCDSYEKKPPKE FLERFKSLLQKMIHQHLSSRTHGSEDS | 339 |
| IL-21_ H35F | 1.769 | MRSSPGNMERIVICLMVIFLGTLVHKSSSQGQDRFMIRMRQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 340 |
| IL-21_ K81Q | 1.774 | MRSSPGNMERIVICLMVIFLGTLVHKSSSQGQDRHMIRMRQLIDI VDQLKNYVNDLVPEFLPAPEDVETNCEWSAFSCFQQAQLKSANTG NNERIINVSIKKLKRKPPSTNAGRRQKHRLTCPSCDSYEKKPPKE FLERFKSLLQKMIHQHLSSRTHGSEDS | 341 |
| IL-21_ R119T | 1.778 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQKHTLTCPSCDSYEKKPPKE FLERFKSLLQKMIHQHLSSRTHGSEDS | 342 |
| IL-21_ R114M | 1.785 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGMRQKHRLTCPSCDSYEKKPPKE FLERFKSLLQKMIHQHLSSRTHGSEDS | 343 |
| IL-21_ N97E | 1.789 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIIEVSIKKLKRKPPSTNAGRRQKHRLTCPSCDSYEKKPPKE FLERFKSLLQKMIHQHLSSRTHGSEDS | 344 |
| IL-21_ R94Q | 1.814 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNEQIINVSIKKLKRKPPSTNAGRRQKHRLTCPSCDSYEKKPPKE FLERFKSLLQKMIHQHLSSRTHGSEDS | 345 |
| IL-21_ K117N | 1.818 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQNHRLTCPSCDSYEKKPPKE FLERFKSLLQKMIHQHLSSRTHGSEDS | 346 |
| IL-21_ R94N | 1.819 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNENIINVSIKKLKRKPPSTNAGRRQKHRLTCPSCDSYEKKPPKE FLERFKSLLQKMIHQHLSSRTHGSEDS | 347 |
| IL-21_ R119G | 1.82 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQKHGLTCPSCDSYEKKPPKE FLERFKSLLQKMIHQHLSSRTHGSEDS | 348 |
| IL-21_ R114A | 1.822 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGARQKHRLTCPSCDSYEKKPPKE FLERFKSLLQKMIHQHLSSRTHGSEDS | 349 |

TABLE 8-continued

IL-21 Single-Mutant Stabilized Variants

| Variant Name | Predicted Affinity | Amino Acid Sequence | SEQ ID NO |
|---|---|---|---|
| IL-21_ R114N | 1.825 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGNRQKHRLTCPSCDSYEKKPPKE FLERFKSLLQKMIHQHLSSRTHGSEDS | 350 |
| IL-21_ K106F | 1.834 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRFPPSTNAGRRQKHRLTCPSCDSYEKKPPKE FLERFKSLLQKMIHQHLSSRTHGSEDS | 351 |
| IL-21_ R114G | 1.851 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGGRQKHRLTCPSCDSYEKKPPKE FLERFKSLLQKMIHQHLSSRTHGSEDS | 352 |
| IL-21_ K101Q | 1.862 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIQKLKRKPPSTNAGRRQKHRLTCPSCDSYEKKPPKE FLERFKSLLQKMIHQHLSSRTHGSEDS | 353 |
| IL-21_ R115Q | 1.867 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRQQKHRLTCPSCDSYEKKPPKE FLERFKSLLQKMIHQHLSSRTHGSEDS | 354 |
| IL-21_ R119P | 1.87 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQKHPLTCPSCDSYEKKPPKE FLERFKSLLQKMIHQHLSSRTHGSEDS | 355 |
| IL-21_ R115L | 1.871 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRLQKHRLTCPSCDSYEKKPPKE FLERFKSLLQKMIHQHLSSRTHGSEDS | 356 |
| IL-21_ N111E | 1.872 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTEAGRRQKHRLTCPSCDSYEKKPPKE FLERFKSLLQKMIHQHLSSRTHGSEDS | 357 |
| IL-21_ H35T | 1.902 | MRSSPGNMERIVICLMVIFLGTLVHKSSSQGQDRTMIRMRQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 358 |
| IL-21_ K104S | 1.903 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLSRKPPSTNAGRRQKHRLTCPSCDSYEKKPPKE FLERFKSLLQKMIHQHLSSRTHGSEDS | 359 |
| IL-21_ R115F | 1.916 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRFQKHRLTCPSCDSYEKKPPKE FLERFKSLLQKMIHQHLSSRTHGSEDS | 360 |
| IL-21_ R115W | 1.936 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRWQKHRLTCPSCDSYEKKPPKE FLERFKSLLQKMIHQHLSSRTHGSEDS | 361 |
| IL-21_ H118T | 1.944 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQKTRLTCPSCDSYEKKPPKE FLERFKSLLQKMIHQHLSSRTHGSEDS | 362 |
| IL-21_ S77D | 1.965 | MRSSPGNMERIVICLMVIFLGTLVHKSSSQGQDRHMIRMRQLIDI VDQLKNYVNDLVPEFLPAPEDVETNCEWSAFDCFQKAQLKSANTG NNERIINVSIKKLKRKPPSTNAGRRQKHRLTCPSCDSYEKKPPKE FLERFKSLLQKMIHQHLSSRTHGSEDS | 363 |

TABLE 8-continued

IL-21 Single-Mutant Stabilized Variants

| Variant Name | Predicted Affinity | Amino Acid Sequence | SEQ ID NO |
|---|---|---|---|
| IL-21_ G113D | 1.965 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNADRRQKHRLTCPSCDSYEKKPPKE FLERFKSLLQKMIHQHLSSRTHGSEDS | 364 |
| IL-21_ K117G | 1.965 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQGHRLTCPSCDSYEKKPPKE FLERFKSLLQKMIHQHLSSRTHGSEDS | 365 |
| IL-21_ K102D | 1.969 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKDLKRKPPSTNAGRRQKHRLTCPSCDSYEKKPPKE FLERFKSLLQKMIHQHLSSRTHGSEDS | 366 |
| IL-21_ R114E | 1.972 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGERQKHRLTCPSCDSYEKKPPKE FLERFKSLLQKMIHQHLSSRTHGSEDS | 367 |
| IL-21_ K104M | 1.976 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLMRKPPSTNAGRRQKHRLTCPSCDSYEKKPPKE FLERFKSLLQKMIHQHLSSRTHGSEDS | 368 |
| IL-21_ N70D | 1.977 | MRSSPGNMERIVICLMVIFLGTLVHKSSSQGQDRHMIRMRQLIDI VDQLKNYVNDLVPEFLPAPEDVETDCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 369 |
| IL-21_ R119L | 1.978 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQKHLLTCPSCDSYEKKPPKE FLERFKSLLQKMIHQHLSSRTHGSEDS | 370 |
| IL-21_ A112D | 1.98 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNDGRRQKHRLTCPSCDSYEKKPPKE FLERFKSLLQKMIHQHLSSRTHGSEDS | 371 |
| IL-21_ Q48E | 1.981 | MRSSPGNMERIVICLMVIFLGTLVHKSSSQGQDRHMIRMRQLIDI VDELKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 372 |
| IL-21_ R115V | 1.984 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRVQKHRLTCPSCDSYEKKPPKE FLERFKSLLQKMIHQHLSSRTHGSEDS | 373 |
| IL-21_ R38H | 1.984 | MRSSPGNMERIVICLMVIFLGTLVHKSSSQGQDRHMIHMRQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 374 |
| IL-21_ Q41E | 1.985 | MRSSPGNMERIVICLMVIFLGTLVHKSSSQGQDRHMIRMRELIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 375 |
| IL-21_ V57D | 1.992 | MRSSPGNMERIVICLMVIFLGTLVHKSSSQGQDRHMIRMRQLIDI VDQLKNYVNDLDPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 376 |
| IL-21_ L61F | 1.998 | MRSSPGNMERIVICLMVIFLGTLVHKSSSQGQDRHMIRMRQLIDI VDQLKNYVNDLVPEFFPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 377 |

TABLE 8-continued

IL-21 Single-Mutant Stabilized Variants

| Variant Name | Predicted Affinity | Amino Acid Sequence | SEQ ID NO |
|---|---|---|---|
| IL-21_ K101N | 2.009 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSINKLKRKPPSTNAGRRQKHRLTCPSCDSYEKKPPKE FLERFKSLLQKMIHQHLSSRTHGSEDS | 378 |
| IL-21_ K117Q | 2.01 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQQHRLTCPSCDSYEKKPPKE FLERFKSLLQKMIHQHLSSRTHGSEDS | 379 |
| IL-21_ H35V | 2.012 | MRSSPGNMERIVICLMVIFLGTLVHKSSSQGQDRVMIRMRQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 380 |
| IL-21_ H35A | 2.013 | MRSSPGNMERIVICLMVIFLGTLVHKSSSQGQDRAMIRMRQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 381 |
| IL-21_ H35Q | 2.018 | MRSSPGNMERIVICLMVIFLGTLVHKSSSQGQDRQMIRMRQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 382 |
| IL-21_ K106L | 2.022 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRLPPSTNAGRRQKHRLTCPSCDSYEKKPPKE FLERFKSLLQKMIHQHLSSRTHGSEDS | 383 |
| IL-21_ K101L | 2.022 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSILKLKRKPPSTNAGRRQKHRLTCPSCDSYEKKPPKE FLERFKSLLQKMIHQHLSSRTHGSEDS | 384 |
| IL-21_ K102N | 2.03 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKNLKRKPPSTNAGRRQKHRLTCPSCDSYEKKPPKE FLERFKSLLQKMIHQHLSSRTHGSEDS | 385 |
| IL-21_ R114W | 2.039 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGWRQKHRLTCPSCDSYEKKPPKE FLERFKSLLQKMIHQHLSSRTHGSEDS | 386 |
| IL-21_ R119Q | 2.04 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQKHQLTCPSCDSYEKKPPKE FLERFKSLLQKMIHQHLSSRTHGSEDS | 387 |
| IL-21_ R40L | 2.059 | MRSSPGNMERIVICLMVIFLGTLVHKSSSQGQDRHMIRMLQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 388 |
| IL-21_ H35N | 2.063 | MRSSPGNMERIVICLMVIFLGTLVHKSSSQGQDRNMIRMRQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 389 |
| IL-21_ R114V | 2.064 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGVRQKHRLTCPSCDSYEKKPPKE FLERFKSLLQKMIHQHLSSRTHGSEDS | 390 |
| IL-21_ K106D | 2.064 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRDPPSTNAGRRQKHRLTCPSCDSYEKKPPKE FLERFKSLLQKMIHQHLSSRTHGSEDS | 391 |

TABLE 8-continued

IL-21 Single-Mutant Stabilized Variants

| Variant Name | Predicted Affinity | Amino Acid Sequence | SEQ ID NO |
|---|---|---|---|
| IL-21_ K50S | 2.07 | MRSSPGNMERIVICLMVIFLGTLVHKSSSQGQDRHMIRMRQLIDI VDQLSNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 392 |
| IL-21_ G113E | 2.071 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAERRQKHRLTCPSCDSYEKKPPKE FLERFKSLLQKMIHQHLSSRTHGSEDS | 393 |
| IL-21_ K106E | 2.074 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKREPPSTNAGRRQKHRLTCPSCDSYEKKPPKE FLERFKSLLQKMIHQHLSSRTHGSEDS | 394 |
| IL-21_ L61Y | 2.077 | MRSSPGNMERIVICLMVIFLGTLVHKSSSQGQDRHMIRMRQLIDI VDQLKNYVNDLVPEFYPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 395 |
| IL-21_ R114Y | 2.083 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGYRQKHRLTCPSCDSYEKKPPKE FLERFKSLLQKMIHQHLSSRTHGSEDS | 396 |
| IL-21_ K50L | 2.086 | MRSSPGNMERIVICLMVIFLGTLVHKSSSQGQDRHMIRMRQLIDI VDQLLNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 397 |
| IL-21_ F60E | 2.086 | MRSSPGNMERIVICLMVIFLGTLVHKSSSQGQDRHMIRMRQLIDI VDQLKNYVNDLVPEELPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 398 |
| IL-21_ K101T | 2.087 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSITKLKRKPPSTNAGRRQKHRLTCPSCDSYEKKPPKE FLERFKSLLQKMIHQHLSSRTHGSEDS | 399 |
| IL-21_ T121D | 2.09 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQKHRLDCPSCDSYEKKPPKE FLERFKSLLQKMIHQHLSSRTHGSEDS | 400 |
| IL-21_ H35S | 2.09 | MRSSPGNMERIVICLMVIFLGTLVHKSSSQGQDRSMIRMRQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 401 |
| IL-21_ L42M | 2.093 | MRSSPGNMERIVICLMVIFLGTLVHKSSSQGQDRHMIRMRQMIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 402 |
| IL-21_ R115G | 2.093 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRGQKHRLTCPSCDSYEKKPPKE FLERFKSLLQKMIHQHLSSRTHGSEDS | 403 |
| IL-21_ S99A | 2.102 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVAIKKLKRKPPSTNAGRRQKHRLTCPSCDSYEKKPPKE FLERFKSLLQKMIHQHLSSRTHGSEDS | 404 |
| IL-21_ M36L | 2.117 | MRSSPGNMERIVICLMVIFLGTLVHKSSSQGQDRHLIRMRQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 405 |

TABLE 8-continued

| IL-21 Single-Mutant Stabilized Variants | | | |
|---|---|---|---|
| Variant Name | Predicted Affinity | Amino Acid Sequence | SEQ ID NO |
| IL-21_ N91E | 2.118 | MRSSPGNMERIVICLMVIFLGTLVHKSSSQGQDRHMIRMRQLIDI VDQLKNYVNDLVPEFLPAPEDVETNCEWSAFSCFQKAQLKSANTG ENERIINVSIKKLKRKPPSTNAGRRQKHRLTCPSCDSYEKKPPKE FLERFKSLLQKMIHQHLSSRTHGSEDS | 406 |
| IL-21_ H149D | 2.121 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIDQHLSSRTHGSEDS | 407 |
| IL-21_ R40M | 2.122 | MRSSPGNMERIVICLMVIFLGTLVHKSSSQGQDRHMIRMMQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 408 |
| IL-21_ N91P | 2.122 | MRSSPGNMERIVICLMVIFLGTLVHKSSSQGQDRHMIRMRQLIDI VDQLKNYVNDLVPEFLPAPEDVETNCEWSAFSCFQKAQLKSANTG PNERIINVSIKKLKRKPPSTNAGRRQKHRLTCPSCDSYEKKPPKE FLERFKSLLQKMIHQHLSSRTHGSEDS | 409 |
| IL-21_ R115Y | 2.122 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRYQKHRLTCPSCDSYEKKPPKE FLERFKSLLQKMIHQHLSSRTHGSEDS | 410 |
| IL-21_ R119Y | 2.123 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQKHYLTCPSCDSYEKKPPKE FLERFKSLLQKMIHQHLSSRTHGSEDS | 411 |
| IL-21_ N70E | 2.141 | MRSSPGNMERIVICLMVIFLGTLVHKSSSQGQDRHMIRMRQLIDI VDQLKNYVNDLVPEFLPAPEDVETECEWSAFSCFQKAQLKSANTG NNERIINVSIKKLKRKPPSTNAGRRQKHRLTCPSCDSYEKKPPKE FLERFKSLLQKMIHQHLSSRTHGSEDS | 412 |
| IL-21_ K117Y | 2.145 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQYHRLTCPSCDSYEKKPPKE FLERFKSLLQKMIHQHLSSRTHGSEDS | 413 |
| IL-21_ P107M | 2.145 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKMPSTNAGRRQKHRLTCPSCDSYEKKPPKE FLERFKSLLQKMIHQHLSSRTHGSEDS | 414 |
| IL-21_ R40Q | 2.146 | MRSSPGNMERIVICLMVIFLGTLVHKSSSQGQDRHMIRMQQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 415 |
| IL-21_ H151D | 2.152 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQDLSSRTHGSEDS | 416 |
| IL-21_ H118N | 2.163 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQKNRLTCPSCDSYEKKPPKE FLERFKSLLQKMIHQHLSSRTHGSEDS | 417 |
| IL-21_ T69E | 2.163 | MRSSPGNMERIVICLMVIFLGTLVHKSSSQGQDRHMIRMRQLIDI VDQLKNYVNDLVPEFLPAPEDVEENCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 418 |
| IL-21_ K104Y | 2.163 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLYRKPPSTNAGRRQKHRLTCPSCDSYEKKPPKE FLERFKSLLQKMIHQHLSSRTHGSEDS | 419 |

TABLE 8-continued

| IL-21 Single-Mutant Stabilized Variants | | | |
|---|---|---|---|
| Variant Name | Predicted Affinity | Amino Acid Sequence | SEQ ID NO |
| IL-21_ R114T | 2.167 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGTRQKHRLTCPSCDSYEKKPPKE FLERFKSLLQKMIHQHLSSRTHGSEDS | 420 |
| IL-21_ K117S | 2.167 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQSHRLTCPSCDSYEKKPPKE FLERFKSLLQKMIHQHLSSRTHGSEDS | 421 |
| IL-21_ H118I | 2.168 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQKIRLTCPSCDSYEKKPPKE FLERFKSLLQKMIHQHLSSRTHGSEDS | 422 |
| IL-21_ S99L | 2.168 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVLIKKLKRKPPSTNAGRRQKHRLTCPSCDSYEKKPPKE FLERFKSLLQKMIHQHLSSRTHGSEDS | 423 |
| IL-21_ S74E | 2.177 | MRSSPGNMERIVICLMVIFLGTLVHKSSSQGQDRHMIRMRQLIDI VDQLKNYVNDLVPEFLPAPEDVETNCEWEAFSCFQKAQLKSANTG NNERIINVSIKKLKRKPPSTNAGRRQKHRLTCPSCDSYEKKPPKE FLERFKSLLQKMIHQHLSSRTHGSEDS | 424 |
| IL-21_ Q83P | 2.178 | MRSSPGNMERIVICLMVIFLGTLVHKSSSQGQDRHMIRMRQLIDI VDQLKNYVNDLVPEFLPAPEDVETNCEWSAFSCFQKAPLKSANTG NNERIINVSIKKLKRKPPSTNAGRRQKHRLTCPSCDSYEKKPPKE FLERFKSLLQKMIHQHLSSRTHGSEDS | 425 |
| IL-21_ K117F | 2.182 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQFHRLTCPSCDSYEKKPPKE FLERFKSLLQKMIHQHLSSRTHGSEDS | 426 |
| IL-21_ P107I | 2.183 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKIPSTNAGRRQKHRLTCPSCDSYEKKPPKE FLERFKSLLQKMIHQHLSSRTHGSEDS | 427 |
| IL-21_ Q32E | 2.183 | MRSSPGNMERIVICLMVIFLGTLVHKSSSQGEDRHMIRMRQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 428 |
| IL-21_ S99M | 2.186 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVMIKKLKRKPPSTNAGRRQKHRLTCPSCDSYEKKPPKE FLERFKSLLQKMIHQHLSSRTHGSEDS | 429 |
| IL-21_ T69D | 2.188 | MRSSPGNMERIVICLMVIFLGTLVHKSSSQGQDRHMIRMRQLIDI VDQLKNYVNDLVPEFLPAPEDVEDNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 430 |
| IL-21_ R119S | 2.189 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQKHSLTCPSCDSYEKKPPKE FLERFKSLLQKMIHQHLSSRTHGSEDS | 431 |
| IL-21_ K117A | 2.196 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQAHRLTCPSCDSYEKKPPKE FLERFKSLLQKMIHQHLSSRTHGSEDS | 432 |
| IL-21_ F60P | 2.211 | MRSSPGNMERIVICLMVIFLGTLVHKSSSQGQDRHMIRMRQLIDI VDQLKNYVNDLVPEPLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 433 |

TABLE 8-continued

| IL-21 Single-Mutant Stabilized Variants | | | |
|---|---|---|---|
| Variant Name | Predicted Affinity | Amino Acid Sequence | SEQ ID NO |
| IL-21_ R40Y | 2.213 | MRSSPGNMERIVICLMVIFLGTLVHKSSSQGQDRHMIRMYQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 434 |
| IL-21_ K81L | 2.216 | MRSSPGNMERIVICLMVIFLGTLVHKSSSQGQDRHMIRMRQLIDI VDQLKNYVNDLVPEFLPAPEDVETNCEWSAFSCFQLAQLKSANTG NNERIINVSIKKLKRKPPSTNAGRRQKHRLTCPSCDSYEKKPPKE FLERFKSLLQKMIHQHLSSRTHGSEDS | 435 |
| IL-21_ R115T | 2.219 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRTQKHRLTCPSCDSYEKKPPKE FLERFKSLLQKMIHQHLSSRTHGSEDS | 436 |
| IL-21_ H118Q | 2.221 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQKQRLTCPSCDSYEKKPPKE FLERFKSLLQKMIHQHLSSRTHGSEDS | 437 |
| IL-21_ Q83D | 2.221 | MRSSPGNMERIVICLMVIFLGTLVHKSSSQGQDRHMIRMRQLIDI VDQLKNYVNDLVPEFLPAPEDVETNCEWSAFSCFQKADLKSANTG NNERIINVSIKKLKRKPPSTNAGRRQKHRLTCPSCDSYEKKPPKE FLERFKSLLQKMIHQHLSSRTHGSEDS | 438 |
| IL-21_ H35I | 2.221 | MRSSPGNMERIVICLMVIFLGTLVHKSSSQGQDRIMIRMRQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 439 |
| IL-21_ S86Y | 2.225 | MRSSPGNMERIVICLMVIFLGTLVHKSSSQGQDRHMIRMRQLIDI VDQLKNYVNDLVPEFLPAPEDVETNCEWSAFSCFQKAQLKYANTG NNERIINVSIKKLKRKPPSTNAGRRQKHRLTCPSCDSYEKKPPKE FLERFKSLLQKMIHQHLSSRTHGSEDS | 440 |
| IL-21_ H118V | 2.225 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLKRKPPSTNAGRRQKVRLTCPSCDSYEKKPPKE FLERFKSLLQKMIHQHLSSRTHGSEDS | 441 |
| IL-21_ H35M | 2.229 | MRSSPGNMERIVICLMVIFLGTLVHKSSSQGQDRMMIRMRQLIDI VDQLKNYVNDLVPEFLPAPEDVETNCEWSAFSCFQKAQLKSANTG NNERIINVSIKKLKRKPPSTNAGRRQKHRLTCPSCDSYEKKPPKE FLERFKSLLQKMIHQHLSSRTHGSEDS | 442 |
| IL-21_ K104E | 2.233 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLERKPPSTNAGRRQKHRLTCPSCDSYEKKPPKE FLERFKSLLQKMIHQHLSSRTHGSEDS | 443 |
| IL-21_ K104Q | 2.234 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNERIINVSIKKLQRKPPSTNAGRRQKHRLTCPSCDSYEKKPPKE FLERFKSLLQKMIHQHLSSRTHGSEDS | 444 |
| IL-21_ R94G | 2.235 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNEGIINVSIKKLKRKPPSTNAGRRQKHRLTCPSCDSYEKKPPKE FLERFKSLLQKMIHQHLSSRTHGSEDS | 445 |
| IL-21_ W73E | 2.242 | MRSSPGNMERIVICLMVIFLGTLVHKSSSQGQDRHMIRMRQLIDI VDQLKNYVNDLVPEFLPAPEDVETNCEESAFSCFQKAQLKSANTG NNERIINVSIKKLKRKPPSTNAGRRQKHRLTCPSCDSYEKKPPKE FLERFKSLLQKMIHQHLSSRTHGSEDS | 446 |
| IL-21_ R94Y | 2.242 | MRSSPGNMERIVICLMVIFLGTLVHKSSSQGQDRHMIRMRQLIDI VDQLKNYVNDLVPEFLPAPEDVETNCEWSAFSCFQKAQLKSANTG NNEYIINVSIKKLKRKPPSTNAGRRQKHRLTCPSCDSYEKKPPKE FLERFKSLLQKMIHQHLSSRTHGSEDS | 447 |

TABLE 8-continued

| IL-21 Single-Mutant Stabilized Variants | | | |
|---|---|---|---|
| Variant Name | Predicted Affinity | Amino Acid Sequence | SEQ ID NO |
| IL-21_ H35G | 2.247 | MRSSPGNMERIVICLMVIFLGTLVHKSSSQGQDRGMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 448 |
| IL-21_ L120E | 2.25 | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRETCPSCDSYEKKPPKEFLERFKSLLQKMIHQHLSSRTHGSEDS | 449 |
| IL-21_ H35L | 2.255 | MRSSPGNMERIVICLMVIFLGTLVHKSSSQGQDRLMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 450 |
| IL-21_ R119F | 2.258 | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHELTCPSCDSYEKKPPKEFLERFKSLLQKMIHQHLSSRTHGSEDS | 451 |
| IL-21_ P107D | 2.272 | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKDPSTNAGRRQKHRLTCPSCDSYEKKPPKEFLERFKSLLQKMIHQHLSSRTHGSEDS | 452 |
| IL-21_ K117P | 2.28 | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQPHRLTCPSCDSYEKKPPKEFLERFKSLLQKMIHQHLSSRTHGSEDS | 453 |
| IL-21_ K117I | 2.288 | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQIHRLTCPSCDSYEKKPPKEFLERFKSLLQKMIHQHLSSRTHGSEDS | 454 |
| IL-21_ N111D | 2.292 | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTDAGRRQKHRLTCPSCDSYEKKPPKEFLERFKSLLQKMIHQHLSSRTHGSEDS | 455 |
| IL-21_ K102F | 2.3 | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKFLKRKPPSTNAGRRQKHRLTCPSCDSYEKKPPKEFLERFKSLLQKMIHQHLSSRTHGSEDS | 456 |
| IL-21_ K50M | 2.308 | MRSSPGNMERIVICLMVIFLGTLVHKSSSQGQDRHMIRMRQLIDIVDQLMNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 457 |
| IL-21_ K117T | 2.31 | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQTHRLTCPSCDSYEKKPPKEFLERFKSLLQKMIHQHLSSRTHGSEDS | 458 |

TABLE 9

| Protein Expression Yields and Purity for Stabilized IL-21-Fc Fusion Proteins | | | | |
|---|---|---|---|---|
| Variant Name | Mutations | Amino Acid Sequence | Predicted Affinity | SEQ ID NO |
| IL-21_3434 | H35E, N91E, R114L | MRSSPGNMERIVICLMVIFLGTLVHKSSSQGQDREMIRMRQLIDIVDQLKNYVNDLVPEFLPAPEDVETNCEWSAFSCFQKAQLKSANTGENERIINVSIKKLKRKPPSTNAGLRQKHRLTCPSCDSYEKKPPKEFLERFKSLLQKMIHQHLSSRTHGSEDS | 0.541 | 459 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_4257 | H35F, L42D, V57D, R114Q | MRSSPGNMERIVICLMVIFLGTLVHKSSSQGQDRFM IRMRQDIDIVDQLKNYVNDLDPEFLPAPEDVETNCE WSAFSCFQKAQLKSANTGNNERIINVSIKKLKRKPP STNAGQRQKHRLTCPSCDSYEKKPPKEFLERFKSLL QKMIHQHLSSRTHGSEDS | 0.572 | 460 |
| IL-21_2988 | R94E, R114T | MRSSPGNMERIVICLMVIFLGTLVHKSSSQGQDRHM IRMRQLIDIVDQLKNYVNDLVPEFLPAPEDVETNCE WSAFSCFQKAQLKSANTGNNEEIINVSIKKLKRKPP STNAGTRQKHRLTCPSCDSYEKKPPKEFLERFKSLL QKMIHQHLSSRTHGSEDS | 0.617 | 461 |
| IL-21_3610 | P107V, R114Q, R115D | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKVP STNAGQDQKHRLTCPSCDSYEKKPPKEFLERFKSLL QKMIHQHLSSRTHGSEDS | 0.653 | 462 |
| IL-21_4177 | H35I, N70G, T110D, A112P | MRSSPGNMERIVICLMVIFLGTLVHKSSSQGQDRIM IRMRQLIDIVDQLKNYVNDLVPEFLPAPEDVETGCE WSAFSCFQKAQLKSANTGNNERIINVSIKKLKRKPP SDNPGRRQKHRLTCPSCDSYEKKPPKEFLERFKSLL QKMIHQHLSSRTHGSEDS | 0.663 | 463 |
| IL-21_4219 | R94D, G113E, R119M, T121E | MRSSPGNMERIVICLMVIFLGTLVHKSSSQGQDRHM IRMRQLIDIVDQLKNYVNDLVPEFLPAPEDVETNCE WSAFSCFQKAQLKSANTGNNEDIINVSIKKLKRKPP STNAERRQKHMLECPSCDSYEKKPPKEFLERFKSLL QKMIHQHLSSRTHGSEDS | 0.675 | 464 |
| IL-21_0910 | I45T, K81D, V98E | MRSSPGNMERIVICLMVIFLGTLVHKSSSQGQDRHM IRMRQLIDTVDQLKNYVNDLVPEFLPAPEDVETNCE WSAFSCFQDAQLKSANTGNNERIINESIKKLKRKPP STNAGRRQKHRLTCPSCDSYEKKPPKEFLERFKSLL QKMIHQHLSSRTHGSEDS | 0.676 | 465 |
| IL-21_2821 | V98D, R115G | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINDSIKKLKRKPP STNAGRGQKHRLTCPSCDSYEKKPPKEFLERFKSLL QKMIHQHLSSRTHGSEDS | 0.693 | 466 |
| IL-21_2897 | Q83E, R114E | MRSSPGNMERIVICLMVIFLGTLVHKSSSQGQDRHM IRMRQLIDIVDQLKNYVNDLVPEFLPAPEDVETNCE WSAFSCFQKAELKSANTGNNERIINVSIKKLKRKPP STNAGERQKHRLTCPSCDSYEKKPPKEFLERFKSLL QKMIHQHLSSRTHGSEDS | 0.702 | 467 |
| IL-21_3620 | K81E, N111L, R115G | MRSSPGNMERIVICLMVIFLGTLVHKSSSQGQDRHM IRMRQLIDIVDQLKNYVNDLVPEFLPAPEDVETNCE WSAFSCFQEAQLKSANTGNNERIINVSIKKLKRKPP STLAGRGQKHRLTCPSCDSYEKKPPKEFLERFKSLL QKMIHQHLSSRTHGSEDS | 0.711 | 468 |
| IL-21_4770 | H35F, R40L, E65G, K106R, R115E | MRSSPGNMERIVICLMVIFLGTLVHKSSSQGQDRFM IRMLQLIDIVDQLKNYVNDLVPEFLPAPGDVETNCE WSAFSCFQKAQLKSANTGNNERIINVSIKKLKRRPP STNAGREQKHRLTCPSCDSYEKKPPKEFLERFKSLL QKMIHQHLSSRTHGSEDS | 0.712 | 469 |
| IL-21_4048 | H35D, Q83G, V98Q, G113E | MRSSPGNMERIVICLMVIFLGTLVHKSSSQGQDRDM IRMRQLIDIVDQLKNYVNDLVPEFLPAPEDVETNCE WSAFSCFQKAGLKSANTGNNERIINQSIKKLKRKPP STNAERRQKHRLTCPSCDSYEKKPPKEFLERFKSLL QKMIHQHLSSRTHGSEDS | 0.719 | 470 |
| IL-21_4869 | Q32V, W73N, S99A, K102G, R115D | MRSSPGNMERIVICLMVIFLGTLVHKSSSQGVDRHM IRMRQLIDIVDQLKNYVNDLVPEFLPAPEDVETNCE NSAFSCFQKAQLKSANTGNNERIINVAIKGLKRKPP STNAGRDQKHRLTCPSCDSYEKKPPKEFLERFKSLL QKMIHQHLSSRTHGSEDS | 0.741 | 471 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_4704 | N51I, T69E, P107L, S109E, R114N | MRSSPGNMERIVICLMVIFLGTLVHKSSSQGQDRHM IRMRQLIDIVDQLKIYVNDLVPEFLPAPEDVEENCE WSAFSCFQKAQLKSANTGNNERIINVSIKKLKRKLP ETNAGNRQKHRLTCPSCDSYEKKPPKEFLERFKSLL QKMIHQHLSSRTHGSEDS | 0.743 | 472 |
| IL-21_4818 | R94E, G113Y, H118D, L120T, T121Y | MRSSPGNMERIVICLMVIFLGTLVHKSSSQGQDRHM IRMRQLIDIVDQLKNYVNDLVPEFLPAPEDVETNCE WSAFSCFQKAQLKSANTGNNEEIINVSIKKLKRKPP STNAYRRQKDRTYCPSCDSYEKKPPKEFLERFKSLL QKMIHQHLSSRTHGSEDS | 0.761 | 473 |
| IL-21_4778 | R94P, P107V, S109L, R114I, H118E | MRSSPGNMERIVICLMVIFLGTLVHKSSSQGQDRHM IRMRQLIDIVDQLKNYVNDLVPEFLPAPEDVETNCE WSAFSCFQKAQLKSANTGNNEPIINVSIKKLKRKVP LTNAGIRQKERLTCPSCDSYEKKPPKEFLERFKSLL QKMIHQHLSSRTHGSEDS | 0.795 | 474 |
| IL-21_4297 | H35Y, W73S, T110V, R115D | MRSSPGNMERIVICLMVIFLGTLVHKSSSQGQDRYM IRMRQLIDIVDQLKNYVNDLVPEFLPAPEDVETNCE SSAFSCFQKAQLKSANTGNNERIINVSIKKLKRKPP SVNAGRDQKHRLTCPSCDSYEKKPPKEFLERFKSLL QKMIHQHLSSRTHGSEDS | 0.808 | 475 |
| IL-21_2857 | N111E, R115D | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STEAGRDQKHRLTCPSCDSYEKKPPKEFLERFKSLL QKMIHQHLSSRTHGSEDS | 0.818 | 476 |
| IL-21_3105 | K81T, R115E | MRSSPGNMERIVICLMVIFLGTLVHKSSSQGQDRHM IRMRQLIDIVDQLKNYVNDLVPEFLPAPEDVETNCE WSAFSCFQTAQLKSANTGNNERIINVSIKKLKRKPP STNAGREQKHRLTCPSCDSYEKKPPKEFLERFKSLL QKMIHQHLSSRTHGSEDS | 0.841 | 477 |
| IL-21_4098 | H35T, V57K, A112D, R114E | MRSSPGNMERIVICLMVIFLGTLVHKSSSQGQDRTM IRMRQLIDIVDQLKNYVNDLKPEFLPAPEDVETNCE WSAFSCFQKAQLKSANTGNNERIINVSIKKLKRKPP STNDGERQKHRLTCPSCDSYEKKPPKEFLERFKSLL QKMIHQHLSSRTHGSEDS | 0.865 | 478 |
| IL-21_2954 | R94E, P107L | MRSSPGNMERIVICLMVIFLGTLVHKSSSQGQDRHM IRMRQLIDIVDQLKNYVNDLVPEFLPAPEDVETNCE WSAFSCFQKAQLKSANTGNNEEIINVSIKKLKRKLP STNAGRRQKHRLTCPSCDSYEKKPPKEFLERFKSLL QKMIHQHLSSRTHGSEDS | 0.878 | 479 |
| IL-21_3581 | R114V, R115E, K117A | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNAGVEQAHRLTCPSCDSYEKKPPKEFLERFKSLL QKMIHQHLSSRTHGSEDS | 0.891 | 480 |
| IL-21_4274 | N91Q, K102Q, T110D, T121L | MRSSPGNMERIVICLMVIFLGTLVHKSSSQGQDRHM IRMRQLIDIVDQLKNYVNDLVPEFLPAPEDVETNCE WSAFSCFQKAQLKSANTGQNERIINVSIKQLKRKPP SDNAGRRQKHRLLCPSCDSYEKKPPKEFLERFKSLL QKMIHQHLSSRTHGSEDS | 0.893 | 481 |
| IL-21_3517 | R40V, N70D, R114G | MRSSPGNMERIVICLMVIFLGTLVHKSSSQGQDRHM IRMVQLIDIVDQLKNYVNDLVPEFLPAPEDVETDCE WSAFSCFQKAQLKSANTGNNERIINVSIKKLKRKPP STNAGGRQKHRLTCPSCDSYEKKPPKEFLERFKSLL QKMIHQHLSSRTHGSEDS | 0.911 | 482 |
| IL-21_4159 | R34S, R94E, S109A, R115I | MRSSPGNMERIVICLMVIFLGTLVHKSSSQGQDSHM IRMRQLIDIVDQLKNYVNDLVPEFLPAPEDVETNCE WSAFSCFQKAQLKSANTGNNEEIINVSIKKLKRKPP ATNAGRIQKHRLTCPSCDSYEKKPPKEFLERFKSLL QKMIHQHLSSRTHGSEDS | 0.912 | 483 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_2178 | Q48S, K50E, E68I, K102Q, R114D | MRSSPGNMERIVICLMVIFLGTLVHKSSSQGQDRHM IRMRQLIDIVDSLENYVNDLVPEFLPAPEDVITNCE WSAFSCFQKAQLKSANTGNNERIINVSIKQLKRKPP STNAGDRQKHRLTCPSCDSYEKKPPKEFLERFKSLL QKMIHQHLSSRTHGSEDS | 0.922 | 484 |
| IL-21_2977 | R94N, H118E | MRSSPGNMERIVICLMVIFLGTLVHKSSSQGQDRHM IRMRQLIDIVDQLKNYVNDLVPEFLPAPEDVETNCE WSAFSCFQKAQLKSANTGNNENIINVSIKKLKRKPP STNAGRRQKERLTCPSCDSYEKKPPKEFLERFKSLL QKMIHQHLSSRTHGSEDS | 0.929 | 485 |
| IL-21_3027 | K81T, K102Q | MRSSPGNMERIVICLMVIFLGTLVHKSSSQGQDRHM IRMRQLIDIVDQLKNYVNDLVPEFLPAPEDVETNCE WSAFSCFQTAQLKSANTGNNERIINVSIKQLKRKPP STNAGRRQKHRLTCPSCDSYEKKPPKEFLERFKSLL QKMIHQHLSSRTHGSEDS | 0.933 | 486 |
| IL-21_4642 | R94T, R114T, R115E, D126E, E135V | MRSSPGNMERIVICLMVIFLGTLVHKSSSQGQDRHM IRMRQLIDIVDQLKNYVNDLVPEFLPAPEDVETNCE WSAFSCFQKAQLKSANTGNNETIINVSIKKLKRKPP STNAGTEQKHRLTCPSCESYEKKPPKVFLERFKSLL QKMIHQHLSSRTHGSEDS | 0.94 | 487 |
| IL-21_3580 | Q32G, N111E, R115P | MRSSPGNMERIVICLMVIFLGTLVHKSSSQGGDRHM IRMRQLIDIVDQLKNYVNDLVPEFLPAPEDVETNCE WSAFSCFQKAQLKSANTGNNERIINVSIKKLKRKPP STEAGRPQKHRLTCPSCDSYEKKPPKEFLERFKSLL QKMIHQHLSSRTHGSEDS | 0.971 | 488 |
| IL-21_2801 | R114I, R115G | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNAGIGQKHRLTCPSCDSYEKKPPKEFLERFKSLL QKMIHQHLSSRTHGSEDS | 0.976 | 489 |
| IL-21_2773 | N70E, R114G | MRSSPGNMERIVICLMVIFLGTLVHKSSSQGQDRHM IRMRQLIDIVDQLKNYVNDLVPEFLPAPEDVETECE WSAFSCFQKAQLKSANTGNNERIINVSIKKLKRKPP STNAGGRQKHRLTCPSCDSYEKKPPKEFLERFKSLL QKMIHQHLSSRTHGSEDS | 0.976 | 490 |
| IL-21_4663 | H35F, R40Y, I45V, T69D, T89A | MRSSPGNMERIVICLMVIFLGTLVHKSSSQGQDRFM IRMYQLIDVVDQLKNYVNDLVPEFLPAPEDVEDNCE WSAFSCFQKAQLKSANAGNNERIINVSIKKLKRKPP STNAGRRQKHRLTCPSCDSYEKKPPKEFLERFKSLL QKMIHQHLSSRTHGSEDS | 0.983 | 491 |
| IL-21_3997 | H35E, N51I, T69D, R115K | MRSSPGNMERIVICLMVIFLGTLVHKSSSQGQDREM IRMRQLIDIVDQLKIYVNDLVPEFLPAPEDVEDNCE WSAFSCFQKAQLKSANTGNNERIINVSIKKLKRKPP STNAGRKQKHRLTCPSCDSYEKKPPKEFLERFKSLL QKMIHQHLSSRTHGSEDS | 0.985 | 492 |
| IL-21_3675 | K101S, R114A, R119H | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSISKLKRKPP STNAGARQKHHLTCPSCDSYEKKPPKEFLERFKSLL QKMIHQHLSSRTHGSEDS | 0.996 | 493 |
| IL-21_2898 | M36L, R115D | MRSSPGNMERIVICLMVIFLGTLVHKSSSQGQDRHL IRMRQLIDIVDQLKNYVNDLVPEFLPAPEDVETNCE WSAFSCFQKAQLKSANTGNNERIINVSIKKLKRKPP STNAGRDQKHRLTCPSCDSYEKKPPKEFLERFKSLL QKMIHQHLSSRTHGSEDS | 1.001 | 494 |
| IL-21_4720 | H35A, E72Y, A112G, G113E, R114Y | MRSSPGNMERIVICLMVIFLGTLVHKSSSQGQDRAM IRMRQLIDIVDQLKNYVNDLVPEFLPAPEDVETNCY WSAFSCFQKAQLKSANTGNNERIINVSIKKLKRKPP STNGEYRQKHRLTCPSCDSYEKKPPKEFLERFKSLL QKMIHQHLSSRTHGSEDS | 1.008 | 495 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_2930 | H35E, G113D | MRSSPGNMERIVICLMVIFLGTLVHKSSSQGQDREM IRMRQLIDIVDQLKNYVNDLVPEFLPAPEDVETNCE WSAFSCFQKAQLKSANTGNNERIINVSIKKLKRKPP STNADRRQKHRLTCPSCDSYEKKPPKEFLERFKSLL QKMIHQHLSSRTHGSEDS | 1.011 | 496 |
| IL-21_4047 | H35E, T69E, K85Q, G113A | MRSSPGNMERIVICLMVIFLGTLVHKSSSQGQDREM IRMRQLIDIVDQLKNYVNDLVPEFLPAPEDVEENCE WSAFSCFQKAQLQSANTGNNERIINVSIKKLKRKPP STNAARRQKHRLTCPSCDSYEKKPPKEFLERFKSLL QKMIHQHLSSRTHGSEDS | 1.027 | 497 |
| IL-21_2812 | R94S, R114A | MRSSPGNMERIVICLMVIFLGTLVHKSSSQGQDRHM IRMRQLIDIVDQLKNYVNDLVPEFLPAPEDVETNCE WSAFSCFQKAQLKSANTGNNESIINVSIKKLKRKPP STNAGARQKHRLTCPSCDSYEKKPPKEFLERFKSLL QKMIHQHLSSRTHGSEDS | 1.042 | 498 |
| IL-21_4286 | 196V, S99T, T110D, R114E | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIVNVTIKKLKRKPP SDNAGERQKHRLTCPSCDSYEKKPPKEFLERFKSLL QKMIHQHLSSRTHGSEDS | 1.07 | 499 |
| IL-21_4131 | Q32E, R38Y, K102Q, N111V | MRSSPGNMERIVICLMVIFLGTLVHKSSSQGEDRHM IYMRQLIDIVDQLKNYVNDLVPEFLPAPEDVETNCE WSAFSCFQKAQLKSANTGNNERIINVSIKQLKRKPP STVAGRRQKHRLTCPSCDSYEKKPPKEFLERFKSLL QKMIHQHLSSRTHGSEDS | 1.071 | 500 |
| IL-21_2715 | R114T, R115E | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNAGTEQKHRLTCPSCDSYEKKPPKEFLERFKSLL QKMIHQHLSSRTHGSEDS | 1.073 | 501 |
| IL-21_4188 | N70A, R94N, P107L, R119T | MRSSPGNMERIVICLMVIFLGTLVHKSSSQGQDRHM IRMRQLIDIVDQLKNYVNDLVPEFLPAPEDVETACE WSAFSCFQKAQLKSANTGNNENIINVSIKKLKRKLP STNAGRRQKHTLTCPSCDSYEKKPPKEFLERFKSLL QKMIHQHLSSRTHGSEDS | 1.078 | 502 |
| IL-21_3569 | H35E, M36Q, N70D | MRSSPGNMERIVICLMVIFLGTLVHKSSSQGQDREQ IRMRQLIDIVDQLKNYVNDLVPEFLPAPEDVETDCE WSAFSCFQKAQLKSANTGNNERIINVSIKKLKRKPP STNAGRRQKHRLTCPSCDSYEKKPPKEFLERFKSLL QKMIHQHLSSRTHGSEDS | 1.08 | 503 |
| IL-21_3394 | R114I, R115G, H118G | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNAGIGQKGRLTCPSCDSYEKKPPKEFLERFKSLL QKMIHQHLSSRTHGSEDS | 1.085 | 504 |
| IL-21_3338 | H35T, M36A, R115P | MRSSPGNMERIVICLMVIFLGTLVHKSSSQGQDRTA IRMRQLIDIVDQLKNYVNDLVPEFLPAPEDVETNCE WSAFSCFQKAQLKSANTGNNERIINVSIKKLKRKPP STNAGRPQKHRLTCPSCDSYEKKPPKEFLERFKSLL QKMIHQHLSSRTHGSEDS | 1.109 | 505 |
| IL-21_2846 | R94T, R119E | MRSSPGNMERIVICLMVIFLGTLVHKSSSQGQDRHM IRMRQLIDIVDQLKNYVNDLVPEFLPAPEDVETNCE WSAFSCFQKAQLKSANTGNNETIINVSIKKLKRKPP STNAGRRQKHELTCPSCDSYEKKPPKEFLERFKSLL QKMIHQHLSSRTHGSEDS | 1.109 | 506 |
| IL-21_1637 | N51H, V57E, N70E, K101E | MRSSPGNMERIVICLMVIFLGTLVHKSSSQGQDRHM IRMRQLIDIVDQLKHYVNDLEPEFLPAPEDVETECE WSAFSCFQKAQLKSANTGNNERIINVSIEKLKRKPP STNAGRRQKHRLTCPSCDSYEKKPPKEFLERFKSLL QKMIHQHLSSRTHGSEDS | 1.114 | 507 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_4232 | Q32S, R34T, F76L, V98D | MRSSPGNMERIVICLMVIFLGTLVHKSSSQGSDTHM IRMRQLIDIVDQLKNYVNDLVPEFLPAPEDVETNCE WSALSCFQKAQLKSANTGNNERIINDSIKKLKRKPP STNAGRRQKHRLTCPSCDSYEKKPPKEFLERFKSLL QKMIHQHLSSRTHGSEDS | 1.118 | 508 |
| IL-21_3556 | N91E, K101S, N111S | MRSSPGNMERIVICLMVIFLGTLVHKSSSQGQDRHM IRMRQLIDIVDQLKNYVNDLVPEFLPAPEDVETNCE WSAFSCFQKAQLKSANTGENERIINVSISKLKRKPP STSAGRRQKHRLTCPSCDSYEKKPPKEFLERFKSLL QKMIHQHLSSRTHGSEDS | 1.144 | 509 |
| IL-21_3622 | S99T, H118S, R119D | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVTIKKLKRKPP STNAGRRQKSDLTCPSCDSYEKKPPKEFLERFKSLL QKMIHQHLSSRTHGSEDS | 1.149 | 510 |
| IL-21_3516 | A112M, G113D, R114T | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNMDTRQKHRLTCPSCDSYEKKPPKEFLERFKSLL QKMIHQHLSSRTHGSEDS | 1.152 | 511 |
| IL-21_2667 | Q32M, R115D | MRSSPGNMERIVICLMVIFLGTLVHKSSSQGMDRHM IRMRQLIDIVDQLKNYVNDLVPEFLPAPEDVETNCE WSAFSCFQKAQLKSANTGNNERIINVSIKKLKRKPP STNAGRDQKHRLTCPSCDSYEKKPPKEFLERFKSLL QKMIHQHLSSRTHGSEDS | 1.156 | 512 |
| IL-21_3642 | H35D, P107I, S109I | MRSSPGNMERIVICLMVIFLGTLVHKSSSQGQDRDM IRMRQLIDIVDQLKNYVNDLVPEFLPAPEDVETNCE WSAFSCFQKAQLKSANTGNNERIINVSIKKLKRKIP ITNAGRRQKHRLTCPSCDSYEKKPPKEFLERFKSLL QKMIHQHLSSRTHGSEDS | 1.158 | 513 |
| IL-21_3306 | H35T, M39L, V98T | MRSSPGNMERIVICLMVIFLGTLVHKSSSQGQDRTM IRLRQLIDIVDQLKNYVNDLVPEFLPAPEDVETNCE WSAFSCFQKAQLKSANTGNNERIINTSIKKLKRKPP STNAGRRQKHRLTCPSCDSYEKKPPKEFLERFKSLL QKMIHQHLSSRTHGSEDS | 1.174 | 514 |
| IL-21_2949 | Q48D, R114A | MRSSPGNMERIVICLMVIFLGTLVHKSSSQGQDRHM IRMRQLIDIVDDLKNYVNDLVPEFLPAPEDVETNCE WSAFSCFQKAQLKSANTGNNERIINVSIKKLKRKPP STNAGARQKHRLTCPSCDSYEKKPPKEFLERFKSLL QKMIHQHLSSRTHGSEDS | 1.176 | 515 |
| IL-21_3056 | R115E, L120E | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNAGREQKHRETCPSCDSYEKKPPKEFLERFKSLL QKMIHQHLSSRTHGSEDS | 1.178 | 516 |
| IL-21_4628 | W73F, P107V, R114K, H118D, R119N | MRSSPGNMERIVICLMVIFLGTLVHKSSSQGQDRHM IRMRQLIDIVDQLKNYVNDLVPEFLPAPEDVETNCE FSAFSCFQKAQLKSANTGNNERIINVSIKKLKRKVP STNAGKRQKDNLTCPSCDSYEKKPPKEFLERFKSLL QKMIHQHLSSRTHGSEDS | 1.181 | 517 |
| IL-21_2704 | R114V, R115G | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNAGVGQKHRLTCPSCDSYEKKPPKEFLERFKSLL QKMIHQHLSSRTHGSEDS | 1.191 | 518 |
| IL-21_3074 | E68K, V98D | MRSSPGNMERIVICLMVIFLGTLVHKSSSQGQDRHM IRMRQLIDIVDQLKNYVNDLVPEFLPAPEDVKTNCE WSAFSCFQKAQLKSANTGNNERIINDSIKKLKRKPP STNAGRRQKHRLTCPSCDSYEKKPPKEFLERFKSLL QKMIHQHLSSRTHGSEDS | 1.193 | 519 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_2809 | N111D, R114G | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STDAGGRQKHRLTCPSCDSYEKKPPKEFLERFKSLL QKMIHQHLSSRTHGSEDS | 1.194 | 520 |
| IL-21_2959 | F60L, R115D | MRSSPGNMERIVICLMVIFLGTLVHKSSSQGQDRHM IRMRQLIDIVDQLKNYVNDLVPELLPAPEDVETNCE WSAFSCFQKAQLKSANTGNNERIINVSIKKLKRKPP STNAGRDQKHRLTCPSCDSYEKKPPKEFLERFKSLL QKMIHQHLSSRTHGSEDS | 1.198 | 521 |
| IL-21_3454 | H35S, S77A, V98M | MRSSPGNMERIVICLMVIFLGTLVHKSSSQGQDRSM IRMRQLIDIVDQLKNYVNDLVPEFLPAPEDVETNCE WSAFACFQKAQLKSANTGNNERIINMSIKKLKRKPP STNAGRRQKHRLTCPSCDSYEKKPPKEFLERFKSLL QKMIHQHLSSRTHGSEDS | 1.199 | 522 |
| IL-21_3399 | E72L, R114A, R119N | MRSSPGNMERIVICLMVIFLGTLVHKSSSQGQDRHM IRMRQLIDIVDQLKNYVNDLVPEFLPAPEDVETNCL WSAFSCFQKAQLKSANTGNNERIINVSIKKLKRKPP STNAGARQKHNLTCPSCDSYEKKPPKEFLERFKSLL QKMIHQHLSSRTHGSEDS | 1.199 | 523 |
| IL-21_4290 | T69E, K101L, N111E, G113S | MRSSPGNMERIVICLMVIFLGTLVHKSSSQGQDRHM IRMRQLIDIVDQLKNYVNDLVPEFLPAPEDVEENCE WSAFSCFQKAQLKSANTGNNERIINVSILKLKRKPP STEASRRQKHRLTCPSCDSYEKKPPKEFLERFKSLL QKMIHQHLSSRTHGSEDS | 1.201 | 524 |
| IL-21_3109 | Q83E, S109P | MRSSPGNMERIVICLMVIFLGTLVHKSSSQGQDRHM IRMRQLIDIVDQLKNYVNDLVPEFLPAPEDVETNCE WSAFSCFQKAELKSANTGNNERIINVSIKKLKRKPP PTNAGRRQKHRLTCPSCDSYEKKPPKEFLERFKSLL QKMIHQHLSSRTHGSEDS | 1.203 | 525 |
| IL-21_4721 | R94Q, N111M, A112E, G113R, R115Y | MRSSPGNMERIVICLMVIFLGTLVHKSSSQGQDRHM IRMRQLIDIVDQLKNYVNDLVPEFLPAPEDVETNCE WSAFSCFQKAQLKSANTGNNEQIINVSIKKLKRKPP STMERRYQKHRLTCPSCDSYEKKPPKEFLERFKSLL QKMIHQHLSSRTHGSEDS | 1.204 | 526 |
| IL-21_3647 | N70H, R94A, A112D | MRSSPGNMERIVICLMVIFLGTLVHKSSSQGQDRHM IRMRQLIDIVDQLKNYVNDLVPEFLPAPEDVETHCE WSAFSCFQKAQLKSANTGNNEAIINVSIKKLKRKPP STNDGRRQKHRLTCPSCDSYEKKPPKEFLERFKSLL QKMIHQHLSSRTHGSEDS | 1.213 | 527 |
| IL-21_3632 | H35E, M36G, K106T | MRSSPGNMERIVICLMVIFLGTLVHKSSSQGQDREG IRMRQLIDIVDQLKNYVNDLVPEFLPAPEDVETNCE WSAFSCFQKAQLKSANTGNNERIINVSIKKLKRTPP STNAGRRQKHRLTCPSCDSYEKKPPKEFLERFKSLL QKMIHQHLSSRTHGSEDS | 1.216 | 528 |
| IL-21_2882 | K81N, N111P | MRSSPGNMERIVICLMVIFLGTLVHKSSSQGQDRHM IRMRQLIDIVDQLKNYVNDLVPEFLPAPEDVETNCE WSAFSCFQNAQLKSANTGNNERIINVSIKKLKRKPP STPAGRRQKHRLTCPSCDSYEKKPPKEFLERFKSLL QKMIHQHLSSRTHGSEDS | 1.219 | 529 |
| IL-21_3709 | Q32I, R40L, K81S | MRSSPGNMERIVICLMVIFLGTLVHKSSSQGIDRHM IRMLQLIDIVDQLKNYVNDLVPEFLPAPEDVETNCE WSAFSCFQSAQLKSANTGNNERIINVSIKKLKRKPP STNAGRRQKHRLTCPSCDSYEKKPPKEFLERFKSLL QKMIHQHLSSRTHGSEDS | 1.223 | 530 |
| IL-21_3426 | H35S, N97D, N111I | MRSSPGNMERIVICLMVIFLGTLVHKSSSQGQDRSM IRMRQLIDIVDQLKNYVNDLVPEFLPAPEDVETNCE WSAFSCFQKAQLKSANTGNNERIIDVSIKKLKRKPP STIAGRRQKHRLTCPSCDSYEKKPPKEFLERFKSLL QKMIHQHLSSRTHGSEDS | 1.225 | 531 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_4887 | H35N, I37F, R40Q, E65S, R115S | MRSSPGNMERIVICLMVIFLGTLVHKSSSQGQDRNM FRMQQLIDIVDQLKNYVNDLVPEFLPAPSDVETNCE WSAFSCFQKAQLKSANTGNNERIINVSIKKLKRKPP STNAGRSQKHRLTCPSCDSYEKKPPKEFLERFKSLL QKMIHQHLSSRTHGSEDS | 1.226 | 532 |
| IL-21_2841 | N70G, Q83E | MRSSPGNMERIVICLMVIFLGTLVHKSSSQGQDRHM IRMRQLIDIVDQLKNYVNDLVPEFLPAPEDVETGCE WSAFSCFQKAELKSANTGNNERIINVSIKKLKRKPP STNAGRRQKHRLTCPSCDSYEKKPPKEFLERFKSLL QKMIHQHLSSRTHGSEDS | 1.228 | 533 |
| IL-21_3367 | T89S, S99A, R114G | MRSSPGNMERIVICLMVIFLGTLVHKSSSQGQDRHM IRMRQLIDIVDQLKNYVNDLVPEFLPAPEDVETNCE WSAFSCFQKAQLKSANSGNNERIINVAIKKLKRKPP STNAGGRQKHRLTCPSCDSYEKKPPKEFLERFKSLL QKMIHQHLSSRTHGSEDS | 1.235 | 534 |
| IL-21_2726 | N70G, R114G | MRSSPGNMERIVICLMVIFLGTLVHKSSSQGQDRHM IRMRQLIDIVDQLKNYVNDLVPEFLPAPEDVETGCE WSAFSCFQKAQLKSANTGNNERIINVSIKKLKRKPP STNAGGRQKHRLTCPSCDSYEKKPPKEFLERFKSLL QKMIHQHLSSRTHGSEDS | 1.238 | 535 |
| IL-21_0403 | K50G, R94E | MRSSPGNMERIVICLMVIFLGTLVHKSSSQGQDRHM IRMRQLIDIVDQLGNYVNDLVPEFLPAPEDVETNCE WSAFSCFQKAQLKSANTGNNEEIINVSIKKLKRKPP STNAGRRQKHRLTCPSCDSYEKKPPKEFLERFKSLL QKMIHQHLSSRTHGSEDS | 1.241 | 536 |
| IL-21_0713 | I45G, P58Q, V98E | MRSSPGNMERIVICLMVIFLGTLVHKSSSQGQDRHM IRMRQLIDGVDQLKNYVNDLVQEFLPAPEDVETNCE WSAFSCFQKAQLKSANTGNNERIINESIKKLKRKPP STNAGRRQKHRLTCPSCDSYEKKPPKEFLERFKSLL QKMIHQHLSSRTHGSEDS | 1.243 | 537 |
| IL-21_2660 | M39L, R115G | MRSSPGNMERIVICLMVIFLGTLVHKSSSQGQDRHM IRLRQLIDIVDQLKNYVNDLVPEFLPAPEDVETNCE WSAFSCFQKAQLKSANTGNNERIINVSIKKLKRKPP STNAGRGQKHRLTCPSCDSYEKKPPKEFLERFKSLL QKMIHQHLSSRTHGSEDS | 1.246 | 538 |
| IL-21_4742 | N70H, W73D, S86V, T89A, K106F | MRSSPGNMERIVICLMVIFLGTLVHKSSSQGQDRHM IRMRQLIDIVDQLKNYVNDLVPEFLPAPEDVETHCE DSAFSCFQKAQLKVANAGNNERIINVSIKKLKREPP STNAGRRQKHRLTCPSCDSYEKKPPKEFLERFKSLL QKMIHQHLSSRTHGSEDS | 1.246 | 539 |
| IL-21_4123 | A112E, H118G, R119T, T121N | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNEGRRQKGTLNCPSCDSYEKKPPKEFLERFKSLL QKMIHQHLSSRTHGSEDS | 1.248 | 540 |
| IL-21_4823 | H35F, M36L, V53E, K106P, R115A | MRSSPGNMERIVICLMVIFLGTLVHKSSSQGQDREL IRMRQLIDIVDQLKNYENDLVPEFLPAPEDVETNCE WSAFSCFQKAQLKSANTGNNERIINVSIKKLKRPPP STNAGRAQKHRLTCPSCDSYEKKPPKEFLERFKSLL QKMIHQHLSSRTHGSEDS | 1.253 | 541 |
| IL-21_3363 | R114G, H118G, T121E | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNAGGRQKGRLECPSCDSYEKKPPKEFLERFKSLL QKMIHQHLSSRTHGSEDS | 1.254 | 542 |
| IL-21_0749 | K50S, P107T, R114V | MRSSPGNMERIVICLMVIFLGTLVHKSSSQGQDRHM IRMRQLIDIVDQLSNYVNDLVPEFLPAPEDVETNCE WSAFSCFQKAQLKSANTGNNERIINVSIKKLKRKTP STNAGVRQKHRLTCPSCDSYEKKPPKEFLERFKSLL QKMIHQHLSSRTHGSEDS | 1.256 | 543 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_2755 | R40M, R114A | MRSSPGNMERIVICLMVIFLGTLVHKSSSQGQDRHM<br>IRMMQLIDIVDQLKNYVNDLVPEFLPAPEDVETNCE<br>WSAFSCFQKAQLKSANTGNNERIINVSIKKLKRKPP<br>STNAGARQKHRLTCPSCDSYEKKPPKEFLERFKSLL<br>QKMIHQHLSSRTHGSEDS | 1.259 | 544 |
| IL-21_4143 | V57N, R94Q, S99A, A112Y | MRSSPGNMERIVICLMVIFLGTLVHKSSSQGQDRHM<br>IRMRQLIDIVDQLKNYVNDLNPEFLPAPEDVETNCE<br>WSAFSCFQKAQLKSANTGNNEQIINVAIKKLKRKPP<br>STNYGRRQKHRLTCPSCDSYEKKPPKEFLERFKSLL<br>QKMIHQHLSSRTHGSEDS | 1.275 | 545 |
| IL-21_4807 | D55E, N88K, G113M, R114A, R115E | MRSSPGNMERIVICLMVIFLGTLVHKSSSQGQDRHM<br>IRMRQLIDIVDQLKNYVNELVPEFLPAPEDVETNCE<br>WSAFSCFQKAQLKSAKTGNNERIINVSIKKLKRKPP<br>STNAMAEQKHRLTCPSCDSYEKKPPKEFLERFKSLL<br>QKMIHQHLSSRTHGSEDS | 1.277 | 546 |
| IL-21_2896 | R115D, T121E | MRSSPGNMERIVICLMVIFLGTLVHKSSSQGQDRHM<br>IRMRQLIDIVDQLKNYVNDLVPEFLPAPEDVETNCE<br>WSAFSCFQKAQLKSANTGNNERIINVSIKKLKRKPP<br>STNAGRDQKHRLECPSCDSYEKKPPKEFLERFKSLL<br>QKMIHQHLSSRTHGSEDS | 1.279 | 547 |
| IL-21_4773 | T110S, R115D, Q116M, H118I, H149Y | MRSSPGNMERIVICLMVIFLGTLVHKSSSQGQDRHM<br>IRMRQLIDIVDQLKNYVNDLVPEFLPAPEDVETNCE<br>WSAFSCFQKAQLKSANTGNNERIINVSIKKLKRKPP<br>SSNAGRDMKIRLTCPSCDSYEKKPPKEFLERFKSLL<br>QKMIYQHLSSRTHGSEDS | 1.282 | 548 |
| IL-21_2918 | N70E, N111D | MRSSPGNMERIVICLMVIFLGTLVHKSSSQGQDRHM<br>IRMRQLIDIVDQLKNYVNDLVPEFLPAPEDVETECE<br>WSAFSCFQKAQLKSANTGNNERIINVSIKKLKRKPP<br>STDAGRRQKHRLTCPSCDSYEKKPPKEFLERFKSLL<br>QKMIHQHLSSRTHGSEDS | 1.282 | 549 |
| IL-21_1468 | I45E, F60S, N97D, K106V | MRSSPGNMERIVICLMVIFLGTLVHKSSSQGQDRHM<br>IRMRQLIDEVDQLKNYVNDLVPESLPAPEDVETNCE<br>WSAFSCFQKAQLKSANTGNNERIIDVSIKKLKRVPP<br>STNAGRRQKHRLTCPSCDSYEKKPPKEFLERFKSLL<br>QKMIHQHLSSRTHGSEDS | 1.283 | 550 |
| IL-21_4062 | H35F, F60S, G113K, R114I | MRSSPGNMERIVICLMVIFLGTLVHKSSSQGQDRFM<br>IRMRQLIDIVDQLKNYVNDLVPESLPAPEDVETNCE<br>WSAFSCFQKAQLKSANTGNNERIINVSIKKLKRKPP<br>STNAKIRQKHRLTCPSCDSYEKKPPKEFLERFKSLL<br>QKMIHQHLSSRTHGSEDS | 1.284 | 551 |
| IL-21_3571 | P58V, K101E, R114A | MRSSPGNMERIVICLMVIFLGTLVHKSSSQGQDRHM<br>IRMRQLIDIVDQLKNYVNDLVVEFLPAPEDVETNCE<br>WSAFSCFQKAQLKSANTGNNERIINVSIEKLKRKPP<br>STNAGARQKHRLTCPSCDSYEKKPPKEFLERFKSLL<br>QKMIHQHLSSRTHGSEDS | 1.29 | 552 |
| IL-21_1205 | N51H, T69E, K81S | MRSSPGNMERIVICLMVIFLGTLVHKSSSQGQDRHM<br>IRMRQLIDIVDQLKHYVNDLVPEFLPAPEDVEENCE<br>WSAFSCFQSAQLKSANTGNNERIINVSIKKLKRKPP<br>STNAGRRQKHRLTCPSCDSYEKKPPKEFLERFKSLL<br>QKMIHQHLSSRTHGSEDS | 1.292 | 553 |
| IL-21_4196 | H35F, M36P, N88E, V98Q | MRSSPGNMERIVICLMVIFLGTLVHKSSSQGQDRFP<br>IRMRQLIDIVDQLKNYVNDLVPEFLPAPEDVETNCE<br>WSAFSCFQKAQLKSAETGNNERIINQSIKKLKRKPP<br>STNAGRRQKHRLTCPSCDSYEKKPPKEFLERFKSLL<br>QKMIHQHLSSRTHGSEDS | 1.294 | 554 |
| IL-21_4827 | D47G, S99A, K106L, N111Q, R114V | MRSSPGNMERIVICLMVIFLGTLVHKSSSQGQDRHM<br>IRMRQLIDIVGQLKNYVNDLVPEFLPAPEDVETNCE<br>WSAFSCFQKAQLKSANTGNNERIINVAIKKLKRLPP<br>STQAGVRQKHRLTCPSCDSYEKKPPKEFLERFKSLL<br>QKMIHQHLSSRTHGSEDS | 1.295 | 555 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_4661 | Q32F, A63T, V98I, R114L, R115Q | MRSSPGNMERIVICLMVIFLGTLVHKSSSQGFDRHM IRMRQLIDIVDQLKNYVNDLVPEFLPTPEDVETNCE WSAFSCFQKAQLKSANTGNNERIINISIKKLKRKPP STNAGLQQKHRLTCPSCDSYEKKPPKEFLERFKSLL QKMIHQHLSSRTHGSEDS | 1.297 | 556 |
| IL-21_4095 | R34L, 195L, S99L, R114S | MRSSPGNMERIVICLMVIFLGTLVHKSSSQGQDLHM IRMRQLIDIVDQLKNYVNDLVPEFLPAPEDVETNCE WSAFSCFQKAQLKSANTGNNERLINVLIKKLKRKPP STNAGSRQKHRLTCPSCDSYEKKPPKEFLERFKSLL QKMIHQHLSSRTHGSEDS | 1.301 | 557 |
| IL-21_2290 | K50T, W73E, Q83E, N111S, A112Y | MRSSPGNMERIVICLMVIFLGTLVHKSSSQGQDRHM IRMRQLIDIVDQLTNYVNDLVPEFLPAPEDVETNCE ESAFSCFQKAELKSANTGNNERIINVSIKKLKRKPP STSYGRRQKHRLTCPSCDSYEKKPPKEFLERFKSLL QKMIHQHLSSRTHGSEDS | 1.302 | 558 |
| IL-21_3446 | I37V, N111E, R114S | MRSSPGNMERIVICLMVIFLGTLVHKSSSQGQDRHM VRMRQLIDIVDQLKNYVNDLVPEFLPAPEDVETNCE WSAFSCFQKAQLKSANTGNNERIINVSIKKLKRKPP STEAGSRQKHRLTCPSCDSYEKKPPKEFLERFKSLL QKMIHQHLSSRTHGSEDS | 1.308 | 559 |
| IL-21_2807 | T69D, R115D | MRSSPGNMERIVICLMVIFLGTLVHKSSSQGQDRHM IRMRQLIDIVDQLKNYVNDLVPEFLPAPEDVEDNCE WSAFSCFQKAQLKSANTGNNERIINVSIKKLKRKPP STNAGRDQKHRLTCPSCDSYEKKPPKEFLERFKSLL QKMIHQHLSSRTHGSEDS | 1.308 | 560 |
| IL-21_2872 | R115G, Q116D | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNAGRGDKHRLTCPSCDSYEKKPPKEFLERFKSLL QKMIHQHLSSRTHGSEDS | 1.31 | 561 |
| IL-21_2292 | H35L, Q41E, I43S, N91S, P107M | MRSSPGNMERIVICLMVIFLGTLVHKSSSQGQDRLM IRMRELSDIVDQLKNYVNDLVPEFLPAPEDVETNCE WSAFSCFQKAQLKSANTGSNERIINVSIKKLKRKMP STNAGRRQKHRLTCPSCDSYEKKPPKEFLERFKSLL QKMIHQHLSSRTHGSEDS | 1.311 | 562 |
| IL-21_2902 | R40M, R114T | MRSSPGNMERIVICLMVIFLGTLVHKSSSQGQDRHM IRMMQLIDIVDQLKNYVNDLVPEFLPAPEDVETNCE WSAFSCFQKAQLKSANTGNNERIINVSIKKLKRKPP STNAGTRQKHRLTCPSCDSYEKKPPKEFLERFKSLL QKMIHQHLSSRTHGSEDS | 1.314 | 563 |
| IL-21_1236 | V53S, K102Q, T110I | MRSSPGNMERIVICLMVIFLGTLVHKSSSQGQDRHM IRMRQLIDIVDQLKNYSNDLVPEFLPAPEDVETNCE WSAFSCFQKAQLKSANTGNNERIINVSIKQLKRKPP SINAGRRQKHRLTCPSCDSYEKKPPKEFLERFKSLL QKMIHQHLSSRTHGSEDS | 1.314 | 564 |
| IL-21_4037 | R34L, R94T, N111I, R114S | MRSSPGNMERIVICLMVIFLGTLVHKSSSQGQDLHM IRMRQLIDIVDQLKNYVNDLVPEFLPAPEDVETNCE WSAFSCFQKAQLKSANTGNNETIINVSIKKLKRKPP STIAGSRQKHRLTCPSCDSYEKKPPKEFLERFKSLL QKMIHQHLSSRTHGSEDS | 1.317 | 565 |
| IL-21_3672 | A112V, G113Y, R115E | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNVYREQKHRLTCPSCDSYEKKPPKEFLERFKSLL QKMIHQHLSSRTHGSEDS | 1.319 | 566 |
| IL-21_2677 | M39L, N111D | MRSSPGNMERIVICLMVIFLGTLVHKSSSQGQDRHM IRLRQLIDIVDQLKNYVNDLVPEFLPAPEDVETNCE WSAFSCFQKAQLKSANTGNNERIINVSIKKLKRKPP STDAGRRQKHRLTCPSCDSYEKKPPKEFLERFKSLL QKMIHQHLSSRTHGSEDS | 1.32 | 567 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_1180 | N51T, V98S, R115S | MRSSPGNMERIVICLMVIFLGTLVHKSSSQGQDRHMIRMRQLIDIVDQLKTYVNDLVPEFLPAPEDVETNCEWSAFSCFQKAQLKSANTGNNERIINSSIKKLKRKPPSTNAGRSQKHRLTCPSCDSYEKKPPKEFLERFKSLLQKMIHQHLSSRTHGSEDS | 1.321 | 568 |
| IL-21_4630 | E72V, V98Q, R114W, H118Q, L120N | MRSSPGNMERIVICLMVIFLGTLVHKSSSQGQDRHMIRMRQLIDIVDQLKNYVNDLVPEFLPAPEDVETNCVWSAFSCFQKAQLKSANTGNNERIINQSIKKLKRKPPSTNAGWRQKQRNTCPSCDSYEKKPPKEFLERFKSLLQKMIHQHLSSRTHGSEDS | 1.321 | 569 |
| IL-21_3481 | D33V, K81T, K102Q | MRSSPGNMERIVICLMVIFLGTLVHKSSSQGQVRHMIRMRQLIDIVDQLKNYVNDLVPEFLPAPEDVETNCEWSAFSCFQTAQLKSANTGNNERIINVSIKQLKRKPPSTNAGRRQKHRLTCPSCDSYEKKPPKEFLERFKSLLQKMIHQHLSSRTHGSEDS | 1.323 | 570 |
| IL-21_4202 | Q32N, A112M, R114G, R115Y | MRSSPGNMERIVICLMVIFLGTLVHKSSSQGNDRHMIRMRQLIDIVDQLKNYVNDLVPEFLPAPEDVETNCEWSAFSCFQKAQLKSANTGNNERIINVSIKKLKRKPPSTNMGGYQKHRLTCPSCDSYEKKPPKEFLERFKSLLQKMIHQHLSSRTHGSEDS | 1.33 | 571 |
| IL-21_2681 | R114T, R115G | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGTGQKHRLTCPSCDSYEKKPPKEFLERFKSLLQKMIHQHLSSRTHGSEDS | 1.334 | 572 |
| IL-21_3555 | N70E, K81N, G113E | MRSSPGNMERIVICLMVIFLGTLVHKSSSQGQDRHMIRMRQLIDIVDQLKNYVNDLVPEFLPAPEDVETECEWSAFSCFQNAQLKSANTGNNERIINVSIKKLKRKPPSTNAERRQKHRLTCPSCDSYEKKPPKEFLERFKSLLQKMIHQHLSSRTHGSEDS | 1.34 | 573 |
| IL-21_3392 | S99L, A112G, R119V | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVLIKKLKRKPPSTNGGRRQKHVLTCPSCDSYEKKPPKEFLERFKSLLQKMIHQHLSSRTHGSEDS | 1.346 | 574 |
| IL-21_4882 | K81T, V98L, S99T, E138D, H149K | MRSSPGNMERIVICLMVIFLGTLVHKSSSQGQDRHMIRMRQLIDIVDQLKNYVNDLVPEFLPAPEDVETNCEWSAFSCFQTAQLKSANTGNNERIINLTIKKLKRKPPSTNAGRRQKHRLTCPSCDSYEKKPPKEFLDRFKSLLQKMIKQHLSSRTHGSEDS | 1.348 | 575 |
| IL-21_3008 | R115V, H118D | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRVQKDRLTCPSCDSYEKKPPKEFLERFKSLLQKMIHQHLSSRTHGSEDS | 1.35 | 576 |
| IL-21_0723 | K50S, S77N, R114G | MRSSPGNMERIVICLMVIFLGTLVHKSSSQGQDRHMIRMRQLIDIVDQLSNYVNDLVPEFLPAPEDVETNCEWSAFNCFQKAQLKSANTGNNERIINVSIKKLKRKPPSTNAGGRQKHRLTCPSCDSYEKKPPKEFLERFKSLLQKMIHQHLSSRTHGSEDS | 1.351 | 577 |
| IL-21_3108 | R114T, R119V | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGTRQKHVLTCPSCDSYEKKPPKEFLERFKSLLQKMIHQHLSSRTHGSEDS | 1.356 | 578 |
| IL-21_3495 | P62H, K81A, R114A | MRSSPGNMERIVICLMVIFLGTLVHKSSSQGQDRHMIRMRQLIDIVDQLKNYVNDLVPEFLHAPEDVETNCEWSAFSCFQAAQLKSANTGNNERIINVSIKKLKRKPPSTNAGARQKHRLTCPSCDSYEKKPPKEFLERFKSLLQKMIHQHLSSRTHGSEDS | 1.359 | 579 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_3685 | A87K, G113S, R115D | MRSSPGNMERIVICLMVIFLGTLVHKSSSQGQDRHMIRMRQLIDIVDQLKNYVNDLVPEFLPAPEDVETNCEWSAFSCFQKAQLKSKNTGNNERIINVSIKKLKRKPPSTNASRDQKHRLTCPSCDSYEKKPPKEFLERFKSLLQKMIHQHLSSRTHGSEDS | 1.363 | 580 |
| IL-21_2853 | Q32N, R114G | MRSSPGNMERIVICLMVIFLGTLVHKSSSQGNDRHMIRMRQLIDIVDQLKNYVNDLVPEFLPAPEDVETNCEWSAFSCFQKAQLKSANTGNNERIINVSIKKLKRKPPSTNAGGRQKHRLTCPSCDSYEKKPPKEFLERFKSLLQKMIHQHLSSRTHGSEDS | 1.368 | 581 |
| IL-21_2761 | S99T, R115E | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVTIKKLKRKPPSTNAGREQKHRLTCPSCDSYEKKPPKEFLERFKSLLQKMIHQHLSSRTHGSEDS | 1.369 | 582 |
| IL-21_2844 | H35E, R40D | MRSSPGNMERIVICLMVIFLGTLVHKSSSQGQDREMIRMDQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 1.372 | 583 |
| IL-21_2789 | R114G, H118T | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGRQKTRLTCPSCDSYEKKPPKEFLERFKSLLQKMIHQHLSSRTHGSEDS | 1.374 | 584 |
| IL-21_4687 | R34P, R40E, K50L, N92E, R115G | MRSSPGNMERIVICLMVIFLGTLVHKSSSQGQDPHMIRMEQLIDIVDQLLNYVNDLVPEFLPAPEDVETNCEWSAFSCFQKAQLKSANTGNEERIINVSIKKLKRKPPSTNAGRGQKHRLTCPSCDSYEKKPPKEFLERFKSLLQKMIHQHLSSRTHGSEDS | 1.374 | 585 |
| IL-21_4280 | R40I, K81A, K106T, N111P | MRSSPGNMERIVICLMVIFLGTLVHKSSSQGQDRHMIRMIQLIDIVDQLKNYVNDLVPEFLPAPEDVETNCEWSAFSCFQAAQLKSANTGNNERIINVSIKKLKRTPPSTPAGRRQKHRLTCPSCDSYEKKPPKEFLERFKSLLQKMIHQHLSSRTHGSEDS | 1.379 | 586 |
| IL-21_3440 | Q32D, D33M, H35A | MRSSPGNMERIVICLMVIFLGTLVHKSSSQGDMRAMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 1.379 | 587 |
| IL-21_1350 | K50S, E65K, 195D, R114M | MRSSPGNMERIVICLMVIFLGTLVHKSSSQGQDRHMIRMRQLIDIVDQLSNYVNDLVPEFLPAPKDVETNCEWSAFSCFQKAQLKSANTGNNERDINVSIKKLKRKPPSTNAGMRQKHRLTCPSCDSYEKKPPKEFLERFKSLLQKMIHQHLSSRTHGSEDS | 1.383 | 588 |
| IL-21_0115 | K50S, K106E | MRSSPGNMERIVICLMVIFLGTLVHKSSSQGQDRHMIRMRQLIDIVDQLSNYVNDLVPEFLPAPEDVETNCEWSAFSCFQKAQLKSANTGNNERIINVSIKKLKREPPSTNAGRRQKHRLTCPSCDSYEKKPPKEFLERFKSLLQKMIHQHLSSRTHGSEDS | 1.385 | 589 |
| IL-21_2838 | R119E, L120Q | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHEQTCPSCDSYEKKPPKEFLERFKSLLQKMIHQHLSSRTHGSEDS | 1.386 | 590 |
| IL-21_4737 | A112L, R114N, H118Q, S142N, Q150I | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNLGNRQKQRLTCPSCDSYEKKPPKEFLERFKNLLQKMIHIHLSSRTHGSEDS | 1.386 | 591 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_2968 | R94T, R114Y | MRSSPGNMERIVICLMVIFLGTLVHKSSSQGQDRHM IRMRQLIDIVDQLKNYVNDLVPEFLPAPEDVETNCE WSAFSCFQKAQLKSANTGNNETIINVSIKKLKRKPP STNAGYRQKHRLTCPSCDSYEKKPPKEFLERFKSLL QKMIHQHLSSRTHGSEDS | 1.393 | 592 |
| IL-21_3459 | T110D, N111T, H118T | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP SDTAGRRQKTRLTCPSCDSYEKKPPKEFLERFKSLL QKMIHQHLSSRTHGSEDS | 1.394 | 593 |
| IL-21_4160 | V57T, S99T, A112S, R114E | MRSSPGNMERIVICLMVIFLGTLVHKSSSQGQDRHM IRMRQLIDIVDQLKNYVNDLTPEFLPAPEDVETNCE WSAFSCFQKAQLKSANTGNNERIINVTIKKLKRKPP STNSGERQKHRLTCPSCDSYEKKPPKEFLERFKSLL QKMIHQHLSSRTHGSEDS | 1.395 | 594 |
| IL-21_3524 | E68M, R114T, R115A | MRSSPGNMERIVICLMVIFLGTLVHKSSSQGQDRHM IRMRQLIDIVDQLKNYVNDLVPEFLPAPEDVMTNCE WSAFSCFQKAQLKSANTGNNERIINVSIKKLKRKPP STNAGTAQKHRLTCPSCDSYEKKPPKEFLERFKSLL QKMIHQHLSSRTHGSEDS | 1.396 | 595 |
| IL-21_3670 | V98L, G113D, L120T | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINLSIKKLKRKPP STNADRRQKHRTTCPSCDSYEKKPPKEFLERFKSLL QKMIHQHLSSRTHGSEDS | 1.415 | 596 |
| IL-21_3457 | H35T, R40V, G113W | MRSSPGNMERIVICLMVIFLGTLVHKSSSQGQDRTM IRMVQLIDIVDQLKNYVNDLVPEFLPAPEDVETNCE WSAFSCFQKAQLKSANTGNNERIINVSIKKLKRKPP STNAWRRQKHRLTCPSCDSYEKKPPKEFLERFKSLL QKMIHQHLSSRTHGSEDS | 1.415 | 597 |
| IL-21_3069 | N111D, H118N | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STDAGRRQKNRLTCPSCDSYEKKPPKEFLERFKSLL QKMIHQHLSSRTHGSEDS | 1.418 | 598 |
| IL-21_4150 | Q48E, V98I, N111S, R114Q | MRSSPGNMERIVICLMVIFLGTLVHKSSSQGQDRHM IRMRQLIDIVDELKNYVNDLVPEFLPAPEDVETNCE WSAFSCFQKAQLKSANTGNNERIINISIKKLKRKPP STSAGQRQKHRLTCPSCDSYEKKPPKEFLERFKSLL QKMIHQHLSSRTHGSEDS | 1.419 | 599 |
| IL-21_4132 | R34P, H35K, K102A, R115A | MRSSPGNMERIVICLMVIFLGTLVHKSSSQGQDPKM IRMRQLIDIVDQLKNYVNDLVPEFLPAPEDVETNCE WSAFSCFQKAQLKSANTGNNERIINVSIKALKRKPP STNAGRAQKHRLTCPSCDSYEKKPPKEFLERFKSLL QKMIHQHLSSRTHGSEDS | 1.423 | 600 |
| IL-21_4007 | M36F, R40K, F60L, A112E | MRSSPGNMERIVICLMVIFLGTLVHKSSSQGQDRHE IRMKQLIDIVDQLKNYVNDLVPELLPAPEDVETNCE WSAFSCFQKAQLKSANTGNNERIINVSIKKLKRKPP STNEGRRQKHRLTCPSCDSYEKKPPKEFLERFKSLL QKMIHQHLSSRTHGSEDS | 1.425 | 601 |
| IL-21_1331 | K50S, F76M, N97G, V98E | MRSSPGNMERIVICLMVIFLGTLVHKSSSQGQDRHM IRMRQLIDIVDQLSNYVNDLVPEFLPAPEDVETNCE WSAMSCFQKAQLKSANTGNNERIIGESIKKLKRKPP STNAGRRQKHRLTCPSCDSYEKKPPKEFLERFKSLL QKMIHQHLSSRTHGSEDS | 1.428 | 602 |
| IL-21_4033 | N70H, R114T, L120G, T121D | MRSSPGNMERIVICLMVIFLGTLVHKSSSQGQDRHM IRMRQLIDIVDQLKNYVNDLVPEFLPAPEDVETHCE WSAFSCFQKAQLKSANTGNNERIINVSIKKLKRKPP STNAGTRQKHRGDCPSCDSYEKKPPKEFLERFKSLL QKMIHQHLSSRTHGSEDS | 1.431 | 603 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_3708 | S77L, V98D, L120H | MRSSPGNMERIVICLMVIFLGTLVHKSSSQGQDRHM IRMRQLIDIVDQLKNYVNDLVPEFLPAPEDVETNCE WSAFLCFQKAQLKSANTGNNERIINDSIKKLKRKPP STNAGRRQKHRHTCPSCDSYEKKPPKEFLERFKSLL QKMIHQHLSSRTHGSEDS | 1.433 | 604 |
| IL-21_3096 | R40G, R114E | MRSSPGNMERIVICLMVIFLGTLVHKSSSQGQDRHM IRMGQLIDIVDQLKNYVNDLVPEFLPAPEDVETNCE WSAFSCFQKAQLKSANTGNNERIINVSIKKLKRKPP STNAGERQKHRLTCPSCDSYEKKPPKEFLERFKSLL QKMIHQHLSSRTHGSEDS | 1.437 | 605 |
| IL-21_3049 | V57N, R115S | MRSSPGNMERIVICLMVIFLGTLVHKSSSQGQDRHM IRMRQLIDIVDQLKNYVNDLNPEFLPAPEDVETNCE WSAFSCFQKAQLKSANTGNNERIINVSIKKLKRKPP STNAGRSQKHRLTCPSCDSYEKKPPKEFLERFKSLL QKMIHQHLSSRTHGSEDS | 1.441 | 606 |
| IL-21_3441 | S99L, N111D, Q116S | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVLIKKLKRKPP STDAGRRSKHRLTCPSCDSYEKKPPKEFLERFKSLL QKMIHQHLSSRTHGSEDS | 1.446 | 607 |
| IL-21_1967 | R38F, K50S, N54A, E68D, K81A | MRSSPGNMERIVICLMVIFLGTLVHKSSSQGQDRHM IFMRQLIDIVDQLSNYVADLVPEFLPAPEDVDTNCE WSAFSCFQAAQLKSANTGNNERIINVSIKKLKRKPP STNAGRRQKHRLTCPSCDSYEKKPPKEFLERFKSLL QKMIHQHLSSRTHGSEDS | 1.45 | 608 |
| IL-21_4250 | H35F, Y52V, V57L, N111E | MRSSPGNMERIVICLMVIFLGTLVHKSSSQGQDRFM IRMRQLIDIVDQLKNVVNDLLPEFLPAPEDVETNCE WSAFSCFQKAQLKSANTGNNERIINVSIKKLKRKPP STEAGRRQKHRLTCPSCDSYEKKPPKEFLERFKSLL QKMIHQHLSSRTHGSEDS | 1.454 | 609 |
| IL-21_0629 | N51S, F60G, K101Q | MRSSPGNMERIVICLMVIFLGTLVHKSSSQGQDRHM IRMRQLIDIVDQLKSYVNDLVPEGLPAPEDVETNCE WSAFSCFQKAQLKSANTGNNERIINVSIQKLKRKPP STNAGRRQKHRLTCPSCDSYEKKPPKEFLERFKSLL QKMIHQHLSSRTHGSEDS | 1.456 | 610 |
| IL-21_3019 | V98S, R115G | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINSSIKKLKRKPP STNAGRGQKHRLTCPSCDSYEKKPPKEFLERFKSLL QKMIHQHLSSRTHGSEDS | 1.456 | 611 |
| IL-21_2895 | Q32N, N111E | MRSSPGNMERIVICLMVIFLGTLVHKSSSQGNDRHM IRMRQLIDIVDQLKNYVNDLVPEFLPAPEDVETNCE WSAFSCFQKAQLKSANTGNNERIINVSIKKLKRKPP STEAGRRQKHRLTCPSCDSYEKKPPKEFLERFKSLL QKMIHQHLSSRTHGSEDS | 1.456 | 612 |
| IL-21_1923 | Q48D, K50S, E65G, V98E, P108Y | MRSSPGNMERIVICLMVIFLGTLVHKSSSQGQDRHM IRMRQLIDIVDDLSNYVNDLVPEFLPAPGDVETNCE WSAFSCFQKAQLKSANTGNNERIINESIKKLKRKPY STNAGRRQKHRLTCPSCDSYEKKPPKEFLERFKSLL QKMIHQHLSSRTHGSEDS | 1.461 | 613 |
| IL-21_4804 | N54K, E72V, N91E, R94A, G113E | MRSSPGNMERIVICLMVIFLGTLVHKSSSQGQDRHM IRMRQLIDIVDQLKNYVKDLVPEFLPAPEDVETNCV WSAFSCFQKAQLKSANTGENEAIINVSIKKLKRKPP STNAERRQKHRLTCPSCDSYEKKPPKEFLERFKSLL QKMIHQHLSSRTHGSEDS | 1.463 | 614 |
| IL-21_3570 | N97S, V98L, R114V | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIISLSIKKLKRKPP STNAGVRQKHRLTCPSCDSYEKKPPKEFLERFKSLL QKMIHQHLSSRTHGSEDS | 1.464 | 615 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_2931 | Q116N, H118E | MRSSPGNMERIVICLMVIFLGTLVHKSSSQGQDRHM<br>IRMRQLIDIVDQLKNYVNDLVPEFLPAPEDVETNCE<br>WSAFSCFQKAQLKSANTGNNERIINVSIKKLKRKPP<br>STNAGRRNKERLTCPSCDSYEKKPPKEFLERFKSLL<br>QKMIHQHLSSRTHGSEDS | 1.465 | 616 |
| IL-21_2353 | Q32G, H35P, M36E, V571, F60P | MRSSPGNMERIVICLMVIFLGTLVHKSSSQGGDRPE<br>IRMRQLIDIVDQLKNYVNDLIPEPLPAPEDVETNCE<br>WSAFSCFQKAQLKSANTGNNERIINVSIKKLKRKPP<br>STNAGRRQKHRLTCPSCDSYEKKPPKEFLERFKSLL<br>QKMIHQHLSSRTHGSEDS | 1.468 | 617 |
| IL-21_4221 | N97T, H118E, R119Q, T121A | MRSSPGNMERIVICLMVIFLGTLVHKSSSQGQDRHM<br>IRMRQLIDIVDQLKNYVNDLVPEFLPAPEDVETNCE<br>WSAFSCFQKAQLKSANTGNNERIITVSIKKLKRKPP<br>STNAGRRQKEQLACPSCDSYEKKPPKEFLERFKSLL<br>QKMIHQHLSSRTHGSEDS | 1.469 | 618 |
| IL-21_2360 | K50L, N51H, V53R, K101S, P107L | MRSSPGNMERIVICLMVIFLGTLVHKSSSQGQDRHM<br>IRMRQLIDIVDQLLHYRNDLVPEFLPAPEDVETNCE<br>WSAFSCFQKAQLKSANTGNNERIINVSISKLKRKLP<br>STNAGRRQKHRLTCPSCDSYEKKPPKEFLERFKSLL<br>QKMIHQHLSSRTHGSEDS | 1.474 | 619 |
| IL-21_4822 | T69M, S77H, N97T, K102Q, P107L | MRSSPGNMERIVICLMVIFLGTLVHKSSSQGQDRHM<br>IRMRQLIDIVDQLKNYVNDLVPEFLPAPEDVEMNCE<br>WSAFHCFQKAQLKSANTGNNERIITVSIKQLKRKLP<br>STNAGRRQKHRLTCPSCDSYEKKPPKEFLERFKSLL<br>QKMIHQHLSSRTHGSEDS | 1.479 | 620 |
| IL-21_3671 | H35T, R40V, D44E | MRSSPGNMERIVICLMVIFLGTLVHKSSSQGQDRTM<br>IRMVQLIEIVDQLKNYVNDLVPEFLPAPEDVETNCE<br>WSAFSCFQKAQLKSANTGNNERIINVSIKKLKRKPP<br>STNAGRRQKHRLTCPSCDSYEKKPPKEFLERFKSLL<br>QKMIHQHLSSRTHGSEDS | 1.481 | 621 |
| IL-21_4101 | R94Q, 195T, N111I, H118E | MRSSPGNMERIVICLMVIFLGTLVHKSSSQGQDRHM<br>IRMRQLIDIVDQLKNYVNDLVPEFLPAPEDVETNCE<br>WSAFSCFQKAQLKSANTGNNEQTINVSIKKLKRKPP<br>STIAGRRQKERLTCPSCDSYEKKPPKEFLERFKSLL<br>QKMIHQHLSSRTHGSEDS | 1.481 | 622 |
| IL-21_2743 | M39L, K81N | MRSSPGNMERIVICLMVIFLGTLVHKSSSQGQDRHM<br>IRLRQLIDIVDQLKNYVNDLVPEFLPAPEDVETNCE<br>WSAFSCFQNAQLKSANTGNNERIINVSIKKLKRKPP<br>STNAGRRQKHRLTCPSCDSYEKKPPKEFLERFKSLL<br>QKMIHQHLSSRTHGSEDS | 1.486 | 623 |
| IL-21_3070 | P107L, R119G | MRSSPGNMERIVICLMVIFLGTLVHKSSSQGQDRHM<br>IRMRQLIDIVDQLKNYVNDLVPEFLPAPEDVETNCE<br>WSAFSCFQKAQLKSANTGNNERIINVSIKKLKRKLP<br>STNAGRRQKHGLTCPSCDSYEKKPPKEFLERFKSLL<br>QKMIHQHLSSRTHGSEDS | 1.49 | 624 |
| IL-21_4879 | E93Q, A112Q, R115E, R119K, H151T | MRSSPGNMERIVICLMVIFLGTLVHKSSSQGQDRHM<br>IRMRQLIDIVDQLKNYVNDLVPEFLPAPEDVETNCE<br>WSAFSCFQKAQLKSANTGNNQRIINVSIKKLKRKPP<br>STNQGREQKHKLTCPSCDSYEKKPPKEFLERFKSLL<br>QKMIHQTLSSRTHGSEDS | 1.492 | 625 |
| IL-21_4754 | H35L, F60L, 195G, G113I, R114T | MRSSPGNMERIVICLMVIFLGTLVHKSSSQGQDRLM<br>IRMRQLIDIVDQLKNYVNDLVPELLPAPEDVETNCE<br>WSAFSCFQKAQLKSANTGNNERGINVSIKKLKRKPP<br>STNAITRQKHRLTCPSCDSYEKKPPKEFLERFKSLL<br>QKMIHQHLSSRTHGSEDS | 1.495 | 626 |
| IL-21_1032 | N51E, F60E, D66E | MRSSPGNMERIVICLMVIFLGTLVHKSSSQGQDRHM<br>IRMRQLIDIVDQLKEYVNDLVPEELPAPEEVETNCE<br>WSAFSCFQKAQLKSANTGNNERIINVSIKKLKRKPP<br>STNAGRRQKHRLTCPSCDSYEKKPPKEFLERFKSLL<br>QKMIHQHLSSRTHGSEDS | 1.5 | 627 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_3084 | M39L, K106D | MRSSPGNMERIVICLMVIFLGTLVHKSSSQGQDRHMIRLRQLIDIVDQLKNYVNDLVPEFLPAPEDVETNCEWSAFSCFQKAQLKSANTGNNERIINVSIKKLKRDPPSTNAGRRQKHRLTCPSCDSYEKKPPKEFLERFKSLLQKMIHQHLSSRTHGSEDS | 1.5 | 628 |
| IL-21_3511 | V98I, R119I, T121E | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINISIKKLKRKPPSTNAGRRQKHILECPSCDSYEKKPPKEFLERFKSLLQKMIHQHLSSRTHGSEDS | 1.509 | 629 |
| IL-21_4178 | Q32P, H35V, R94Q, A112Q | MRSSPGNMERIVICLMVIFLGTLVHKSSSQGPDRVMIRMRQLIDIVDQLKNYVNDLVPEFLPAPEDVETNCEWSAFSCFQKAQLKSANTGNNEQIINVSIKKLKRKPPSTNQGRRQKHRLTCPSCDSYEKKPPKEFLERFKSLLQKMIHQHLSSRTHGSEDS | 1.51 | 630 |
| IL-21_4066 | M36L, T89S, N91T, R115G | MRSSPGNMERIVICLMVIFLGTLVHKSSSQGQDRHLIRMRQLIDIVDQLKNYVNDLVPEFLPAPEDVETNCEWSAFSCFQKAQLKSANSGTNERIINVSIKKLKRKPPSTNAGRGQKHRLTCPSCDSYEKKPPKEFLERFKSLLQKMIHQHLSSRTHGSEDS | 1.514 | 631 |
| IL-21_3586 | N54E, Q83G, R114A | MRSSPGNMERIVICLMVIFLGTLVHKSSSQGQDRHMIRMRQLIDIVDQLKNYVEDLVPEFLPAPEDVETNCEWSAFSCFQKAGLKSANTGNNERIINVSIKKLKRKPPSTNAGARQKHRLTCPSCDSYEKKPPKEFLERFKSLLQKMIHQHLSSRTHGSEDS | 1.515 | 632 |
| IL-21_2282 | N54S, F60E, N70V, R114K, R115E | MRSSPGNMERIVICLMVIFLGTLVHKSSSQGQDRHMIRMRQLIDIVDQLKNYVSDLVPEELPAPEDVETVCEWSAFSCFQKAQLKSANTGNNERIINVSIKKLKRKPPSTNAGKEQKHRLTCPSCDSYEKKPPKEFLERFKSLLQKMIHQHLSSRTHGSEDS | 1.518 | 633 |
| IL-21_2800 | R114K, R115G | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGKGQKHRLTCPSCDSYEKKPPKEFLERFKSLLQKMIHQHLSSRTHGSEDS | 1.52 | 634 |
| IL-21_3107 | R114T, R119L | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGTRQKHLLTCPSCDSYEKKPPKEFLERFKSLLQKMIHQHLSSRTHGSEDS | 1.524 | 635 |
| IL-21_2687 | H35S, N70E | MRSSPGNMERIVICLMVIFLGTLVHKSSSQGQDRSMIRMRQLIDIVDQLKNYVNDLVPEFLPAPEDVETECEWSAFSCFQKAQLKSANTGNNERIINVSIKKLKRKPPSTNAGRRQKHRLTCPSCDSYEKKPPKEFLERFKSLLQKMIHQHLSSRTHGSEDS | 1.525 | 636 |
| IL-21_2889 | H35Q, V57E | MRSSPGNMERIVICLMVIFLGTLVHKSSSQGQDRQMIRMRQLIDIVDQLKNYVNDLEPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 1.527 | 637 |
| IL-21_2758 | R114T, R119T | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGTRQKHTLTCPSCDSYEKKPPKEFLERFKSLLQKMIHQHLSSRTHGSEDS | 1.529 | 638 |
| IL-21_3473 | Q32D, A87S, R115G | MRSSPGNMERIVICLMVIFLGTLVHKSSSQGDDRHMIRMRQLIDIVDQLKNYVNDLVPEFLPAPEDVETNCEWSAFSCFQKAQLKSSNTGNNERIINVSIKKLKRKPPSTNAGRGQKHRLTCPSCDSYEKKPPKEFLERFKSLLQKMIHQHLSSRTHGSEDS | 1.534 | 639 |

TABLE 9-continued

| Variant Name | Mutations | Amino Acid Sequence | Predicted Affinity | SEQ ID NO |
|---|---|---|---|---|
| Protein Expression Yields and Purity for Stabilized IL-21-Fc Fusion Proteins | | | | |
| IL-21_4779 | H35S, R38F, S86L, N111E, A112P | MRSSPGNMERIVICLMVIFLGTLVHKSSSQGQDRSMIFMRQLIDIVDQLKNYVNDLVPEFLPAPEDVETNCEWSAFSCFQKAQLKLANTGNNERIINVSIKKLKRKPPSTEPGRRQKHRLTCPSCDSYEKKPPKEFLERFKSLLQKMIHQHLSSRTHGSEDS | 1.537 | 640 |
| IL-21_4118 | H35K, K81D, N97T, N111P | MRSSPGNMERIVICLMVIFLGTLVHKSSSQGQDRKMIRMRQLIDIVDQLKNYVNDLVPEFLPAPEDVETNCEWSAFSCFQDAQLKSANTGNNERIITVSIKKLKRKPPSTPAGRRQKHRLTCPSCDSYEKKPPKEFLERFKSLLQKMIHQHLSSRTHGSEDS | 1.538 | 641 |
| IL-21_3351 | R34T, N111E, R114V | MRSSPGNMERIVICLMVIFLGTLVHKSSSQGQDTHMIRMRQLIDIVDQLKNYVNDLVPEFLPAPEDVETNCEWSAFSCFQKAQLKSANTGNNERIINVSIKKLKRKPPSTEAGVRQKHRLTCPSCDSYEKKPPKEFLERFKSLLQKMIHQHLSSRTHGSEDS | 1.538 | 642 |
| IL-21_1586 | Q32A, H35A, N51H, V98A | MRSSPGNMERIVICLMVIFLGTLVHKSSSQGADRAMIRMRQLIDIVDQLKHYVNDLVPEFLPAPEDVETNCEWSAFSCFQKAQLKSANTGNNERIINASIKKLKRKPPSTNAGRRQKHRLTCPSCDSYEKKPPKEFLERFKSLLQKMIHQHLSSRTHGSEDS | 1.538 | 643 |
| IL-21_2940 | S77T, H118D | MRSSPGNMERIVICLMVIFLGTLVHKSSSQGQDRHMIRMRQLIDIVDQLKNYVNDLVPEFLPAPEDVETNCEWSAFTCFQKAQLKSANTGNNERIINVSIKKLKRKPPSTNAGRRQKDRLTCPSCDSYEKKPPKEFLERFKSLLQKMIHQHLSSRTHGSEDS | 1.547 | 644 |
| IL-21_2718 | R40E, R114Q | MRSSPGNMERIVICLMVIFLGTLVHKSSSQGQDRHMIRMEQLIDIVDQLKNYVNDLVPEFLPAPEDVETNCEWSAFSCFQKAQLKSANTGNNERIINVSIKKLKRKPPSTNAGQRQKHRLTCPSCDSYEKKPPKEFLERFKSLLQKMIHQHLSSRTHGSEDS | 1.554 | 645 |
| IL-21_3577 | H35T, V98D, R105K | MRSSPGNMERIVICLMVIFLGTLVHKSSSQGQDRTMIRMRQLIDIVDQLKNYVNDLVPEFLPAPEDVETNCEWSAFSCFQKAQLKSANTGNNERIINDSIKKLKKKPPSTNAGRRQKHRLTCPSCDSYEKKPPKEFLERFKSLLQKMIHQHLSSRTHGSEDS | 1.554 | 646 |
| IL-21_1540 | R40L, D44S, N97E, R114F | MRSSPGNMERIVICLMVIFLGTLVHKSSSQGQDRHMIRMLQLISIVDQLKNYVNDLVPEFLPAPEDVETNCEWSAFSCFQKAQLKSANTGNNERIIEVSIKKLKRKPPSTNAGFRQKHRLTCPSCDSYEKKPPKEFLERFKSLLQKMIHQHLSSRTHGSEDS | 1.555 | 647 |
| IL-21_2723 | T69D, R114G | MRSSPGNMERIVICLMVIFLGTLVHKSSSQGQDRHMIRMRQLIDIVDQLKNYVNDLVPEFLPAPEDVEDNCEWSAFSCFQKAQLKSANTGNNERIINVSIKKLKRKPPSTNAGGRQKHRLTCPSCDSYEKKPPKEFLERFKSLLQKMIHQHLSSRTHGSEDS | 1.556 | 648 |
| IL-21_4726 | K85S, S109A, R114A, L120N, H149K | MRSSPGNMERIVICLMVIFLGTLVHKSSSQGQDRHMIRMRQLIDIVDQLKNYVNDLVPEFLPAPEDVETNCEWSAFSCFQKAQLSSANTGNNERIINVSIKKLKRKPPATNAGARQKHRNTCPSCDSYEKKPPKEFLERFKSLLQKMIKQHLSSRTHGSEDS | 1.557 | 649 |
| IL-21_2797 | H35G, R94T | MRSSPGNMERIVICLMVIFLGTLVHKSSSQGQDRGMIRMRQLIDIVDQLKNYVNDLVPEFLPAPEDVETNCEWSAFSCFQKAQLKSANTGNNETIINVSIKKLKRKPPSTNAGRRQKHRLTCPSCDSYEKKPPKEFLERFKSLLQKMIHQHLSSRTHGSEDS | 1.559 | 650 |
| IL-21_0489 | Q32P, F60E | MRSSPGNMERIVICLMVIFLGTLVHKSSSQGPDRHMIRMRQLIDIVDQLKNYVNDLVPEELPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 1.56 | 651 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_3075 | H118N, R119T | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNAGRRQKNTLTCPSCDSYEKKPPKEFLERFKSLL QKMIHQHLSSRTHGSEDS | 1.564 | 652 |
| IL-21_4892 | H35S, M36L, P58E, K104A, R114H | MRSSPGNMERIVICLMVIFLGTLVHKSSSQGQDRSL IRMRQLIDIVDQLKNYVNDLVEEFLPAPEDVETNCE WSAFSCFQKAQLKSANTGNNERIINVSIKKLARKPP STNAGHRQKHRLTCPSCDSYEKKPPKEFLERFKSLL QKMIHQHLSSRTHGSEDS | 1.565 | 653 |
| IL-21_2274 | I37Y, N51H, D66K, V98E, K106T | MRSSPGNMERIVICLMVIFLGTLVHKSSSQGQDRHM YRMRQLIDIVDQLKHYVNDLVPEFLPAPEKVETNCE WSAFSCFQKAQLKSANTGNNERIINESIKKLKRTPP STNAGRRQKHRLTCPSCDSYEKKPPKEFLERFKSLL QKMIHQHLSSRTHGSEDS | 1.57 | 654 |
| IL-21_1392 | H35S, K50G, F60N, L61Y | MRSSPGNMERIVICLMVIFLGTLVHKSSSQGQDRSM IRMRQLIDIVDQLGNYVNDLVPENYPAPEDVETNCE WSAFSCFQKAQLKSANTGNNERIINVSIKKLKRKPP STNAGRRQKHRLTCPSCDSYEKKPPKEFLERFKSLL QKMIHQHLSSRTHGSEDS | 1.571 | 655 |
| IL-21_2782 | R114T, H118N | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNAGTRQKNRLTCPSCDSYEKKPPKEFLERFKSLL QKMIHQHLSSRTHGSEDS | 1.575 | 656 |
| IL-21_2724 | N111S, R119E | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STSAGRRQKHELTCPSCDSYEKKPPKEFLERFKSLL QKMIHQHLSSRTHGSEDS | 1.576 | 657 |
| IL-21_2861 | R40K, N91E | MRSSPGNMERIVICLMVIFLGTLVHKSSSQGQDRHM IRMKQLIDIVDQLKNYVNDLVPEFLPAPEDVETNCE WSAFSCFQKAQLKSANTGENERIINVSIKKLKRKPP STNAGRRQKHRLTCPSCDSYEKKPPKEFLERFKSLL QKMIHQHLSSRTHGSEDS | 1.582 | 658 |
| IL-21_4659 | H35V, K50G, T69E, Q83T, S99G | MRSSPGNMERIVICLMVIFLGTLVHKSSSQGQDRVM IRMRQLIDIVDQLGNYVNDLVPEFLPAPEDVEENCE WSAFSCFQKATLKSANTGNNERIINVGIKKLKRKPP STNAGRRQKHRLTCPSCDSYEKKPPKEFLERFKSLL QKMIHQHLSSRTHGSEDS | 1.582 | 659 |
| IL-21_3616 | N97T, R114V, R115F | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIITVSIKKLKRKPP STNAGVFQKHRLTCPSCDSYEKKPPKEFLERFKSLL QKMIHQHLSSRTHGSEDS | 1.585 | 660 |
| IL-21_3417 | K50E, N111Q, R115G | MRSSPGNMERIVICLMVIFLGTLVHKSSSQGQDRHM IRMRQLIDIVDQLENYVNDLVPEFLPAPEDVETNCE WSAFSCFQKAQLKSANTGNNERIINVSIKKLKRKPP STQAGRGQKHRLTCPSCDSYEKKPPKEFLERFKSLL QKMIHQHLSSRTHGSEDS | 1.592 | 661 |
| IL-21_3012 | S109A, R115E | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP ATNAGREQKHRLTCPSCDSYEKKPPKEFLERFKSLL QKMIHQHLSSRTHGSEDS | 1.598 | 662 |
| IL-21_2839 | R94T, S109P | MRSSPGNMERIVICLMVIFLGTLVHKSSSQGQDRHM IRMRQLIDIVDQLKNYVNDLVPEFLPAPEDVETNCE WSAFSCFQKAQLKSANTGNNETIINVSIKKLKRKPP PTNAGRRQKHRLTCPSCDSYEKKPPKEFLERFKSLL QKMIHQHLSSRTHGSEDS | 1.599 | 663 |

TABLE 9-continued

| Protein Expression Yields and Purity for Stabilized IL-21-Fc Fusion Proteins | | | | |
|---|---|---|---|---|
| Variant Name | Mutations | Amino Acid Sequence | Predicted Affinity | SEQ ID NO |
| IL-21_2786 | N70E, R114S | MRSSPGNMERIVICLMVIFLGTLVHKSSSQGQDRHM IRMRQLIDIVDQLKNYVNDLVPEFLPAPEDVETECE WSAFSCFQKAQLKSANTGNNERIINVSIKKLKRKPP STNAGSRQKHRLTCPSCDSYEKKPPKEFLERFKSLL QKMIHQHLSSRTHGSEDS | 1.6 | 664 |
| IL-21_3169 | D33E, H35T, M36I | MRSSPGNMERIVICLMVIFLGTLVHKSSSQGQERTI IRMRQLIDIVDQLKNYVNDLVPEFLPAPEDVETNCE WSAFSCFQKAQLKSANTGNNERIINVSIKKLKRKPP STNAGRRQKHRLTCPSCDSYEKKPPKEFLERFKSLL QKMIHQHLSSRTHGSEDS | 1.601 | 665 |
| IL-21_3000 | S99T, R115V | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVTIKKLKRKPP STNAGRVQKHRLTCPSCDSYEKKPPKEFLERFKSLL QKMIHQHLSSRTHGSEDS | 1.608 | 666 |
| IL-21_2833 | H35A, T69D | MRSSPGNMERIVICLMVIFLGTLVHKSSSQGQDRAM IRMRQLIDIVDQLKNYVNDLVPEFLPAPEDVEDNCE WSAFSCFQKAQLKSANTGNNERIINVSIKKLKRKPP STNAGRRQKHRLTCPSCDSYEKKPPKEFLERFKSLL QKMIHQHLSSRTHGSEDS | 1.609 | 667 |
| IL-21_4307 | R38F, N70H, S99D, R115A | MRSSPGNMERIVICLMVIFLGTLVHKSSSQGQDRHM IFMRQLIDIVDQLKNYVNDLVPEFLPAPEDVETHCE WSAFSCFQKAQLKSANTGNNERIINVDIKKLKRKPP STNAGRAQKHRLTCPSCDSYEKKPPKEFLERFKSLL QKMIHQHLSSRTHGSEDS | 1.612 | 668 |
| IL-21_3908 | I37E, K81L, R94Q, R115P | MRSSPGNMERIVICLMVIFLGTLVHKSSSQGQDRHM ERMRQLIDIVDQLKNYVNDLVPEFLPAPEDVETNCE WSAFSCFQLAQLKSANTGNNEQIINVSIKKLKRKPP STNAGRPQKHRLTCPSCDSYEKKPPKEFLERFKSLL QKMIHQHLSSRTHGSEDS | 1.614 | 669 |
| IL-21_3003 | M36T, Q83E | MRSSPGNMERIVICLMVIFLGTLVHKSSSQGQDRHT IRMRQLIDIVDQLKNYVNDLVPEFLPAPEDVETNCE WSAFSCFQKAELKSANTGNNERIINVSIKKLKRKPP STNAGRRQKHRLTCPSCDSYEKKPPKEFLERFKSLL QKMIHQHLSSRTHGSEDS | 1.618 | 670 |
| IL-21_2856 | A112G, R114N | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNGGNRQKHRLTCPSCDSYEKKPPKEFLERFKSLL QKMIHQHLSSRTHGSEDS | 1.619 | 671 |
| IL-21_3097 | R40T, R114V | MRSSPGNMERIVICLMVIFLGTLVHKSSSQGQDRHM IRMTQLIDIVDQLKNYVNDLVPEFLPAPEDVETNCE WSAFSCFQKAQLKSANTGNNERIINVSIKKLKRKPP STNAGVRQKHRLTCPSCDSYEKKPPKEFLERFKSLL QKMIHQHLSSRTHGSEDS | 1.62 | 672 |
| IL-21_4187 | D33E, H35I, L42M, E72Y | MRSSPGNMERIVICLMVIFLGTLVHKSSSQGQERIM IRMRQMIDIVDQLKNYVNDLVPEFLPAPEDVETNCY WSAFSCFQKAQLKSANTGNNERIINVSIKKLKRKPP STNAGRRQKHRLTCPSCDSYEKKPPKEFLERFKSLL QKMIHQHLSSRTHGSEDS | 1.621 | 673 |
| IL-21_2154 | R34D, H35S, F60T, N88K, R94E | MRSSPGNMERIVICLMVIFLGTLVHKSSSQGQDDSM IRMRQLIDIVDQLKNYVNDLVPETLPAPEDVETNCE WSAFSCFQKAQLKSAKTGNNEEIINVSIKKLKRKPP STNAGRRQKHRLTCPSCDSYEKKPPKEFLERFKSLL QKMIHQHLSSRTHGSEDS | 1.622 | 674 |
| IL-21_3040 | H35T, S109I | MRSSPGNMERIVICLMVIFLGTLVHKSSSQGQDRTM IRMRQLIDIVDQLKNYVNDLVPEFLPAPEDVETNCE WSAFSCFQKAQLKSANTGNNERIINVSIKKLKRKPP ITNAGRRQKHRLTCPSCDSYEKKPPKEFLERFKSLL QKMIHQHLSSRTHGSEDS | 1.625 | 675 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_2691 | H35G, R40E | MRSSPGNMERIVICLMVIFLGTLVHKSSSQGQDRGMIRMEQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 1.625 | 676 |
| IL-21_3449 | R34P, S99A, A112E | MRSSPGNMERIVICLMVIFLGTLVHKSSSQGQDPHMIRMRQLIDIVDQLKNYVNDLVPEFLPAPEDVETNCEWSAFSCFQKAQLKSANTGNNERIINVAIKKLKRKPPSTNEGRRQKHRLTCPSCDSYEKKPPKEFLERFKSLLQKMIHQHLSSRTHGSEDS | 1.626 | 677 |
| IL-21_4279 | Q32M, E72D, S99I, R115M | MRSSPGNMERIVICLMVIFLGTLVHKSSSQGMDRHMIRMRQLIDIVDQLKNYVNDLVPEFLPAPEDVETNCDWSAFSCFQKAQLKSANTGNNERIINVIIKKLKRKPPSTNAGRMQKHRLTCPSCDSYEKKPPKEFLERFKSLLQKMIHQHLSSRTHGSEDS | 1.631 | 678 |
| IL-21_1382 | D33H, K50S, Q83E, R114N | MRSSPGNMERIVICLMVIFLGTLVHKSSSQGQHRHMIRMRQLIDIVDQLSNYVNDLVPEFLPAPEDVETNCEWSAFSCFQKAELKSANTGNNERIINVSIKKLKRKPPSTNAGNRQKHRLTCPSCDSYEKKPPKEFLERFKSLLQKMIHQHLSSRTHGSEDS | 1.632 | 679 |
| IL-21_3072 | H35G, V98Q | MRSSPGNMERIVICLMVIFLGTLVHKSSSQGQDRGMIRMRQLIDIVDQLKNYVNDLVPEFLPAPEDVETNCEWSAFSCFQKAQLKSANTGNNERIINQSIKKLKRKPPSTNAGRRQKHRLTCPSCDSYEKKPPKEFLERFKSLLQKMIHQHLSSRTHGSEDS | 1.637 | 680 |
| IL-21_3492 | N70E, R94T, S142N | MRSSPGNMERIVICLMVIFLGTLVHKSSSQGQDRHMIRMRQLIDIVDQLKNYVNDLVPEFLPAPEDVETECEWSAFSCFQKAQLKSANTGNNETIINVSIKKLKRKPPSTNAGRRQKHRLTCPSCDSYEKKPPKEFLERFKNLLQKMIHQHLSSRTHGSEDS | 1.638 | 681 |
| IL-21_4800 | R94E, N97K, P107T, R119I, H151R | MRSSPGNMERIVICLMVIFLGTLVHKSSSQGQDRHMIRMRQLIDIVDQLKNYVNDLVPEFLPAPEDVETNCEWSAFSCFQKAQLKSANTGNNEEIIKVSIKKLKRKTPSTNAGRRQKHILTCPSCDSYEKKPPKEFLERFKSLLQKMIHQRLSSRTHGSEDS | 1.638 | 682 |
| IL-21_4107 | R40K, N91K, K106T, R114G | MRSSPGNMERIVICLMVIFLGTLVHKSSSQGQDRHMIRMKQLIDIVDQLKNYVNDLVPEFLPAPEDVETNCEWSAFSCFQKAQLKSANTGKNERIINVSIKKLKRTPPSTNAGGRQKHRLTCPSCDSYEKKPPKEFLERFKSLLQKMIHQHLSSRTHGSEDS | 1.646 | 683 |
| IL-21_0982 | N51H, V57D, V98S | MRSSPGNMERIVICLMVIFLGTLVHKSSSQGQDRHMIRMRQLIDIVDQLKHYVNDLDPEFLPAPEDVETNCEWSAFSCFQKAQLKSANTGNNERIINSSIKKLKRKPPSTNAGRRQKHRLTCPSCDSYEKKPPKEFLERFKSLLQKMIHQHLSSRTHGSEDS | 1.647 | 684 |
| IL-21_3604 | R115G, L120S, Q150H | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRGQKHRSTCPSCDSYEKKPPKEFLERFKSLLQKMIHHHLSSRTHGSEDS | 1.648 | 685 |
| IL-21_3025 | N51E, R114A | MRSSPGNMERIVICLMVIFLGTLVHKSSSQGQDRHMIRMRQLIDIVDQLKEYVNDLVPEFLPAPEDVETNCEWSAFSCFQKAQLKSANTGNNERIINVSIKKLKRKPPSTNAGARQKHRLTCPSCDSYEKKPPKEFLERFKSLLQKMIHQHLSSRTHGSEDS | 1.648 | 686 |
| IL-21_4162 | E68G, T69E, S99A, A112V | MRSSPGNMERIVICLMVIFLGTLVHKSSSQGQDRHMIRMRQLIDIVDQLKNYVNDLVPEFLPAPEDVGENCEWSAFSCFQKAQLKSANTGNNERIINVAIKKLKRKPPSTNVGRRQKHRLTCPSCDSYEKKPPKEFLERFKSLLQKMIHQHLSSRTHGSEDS | 1.648 | 687 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_3076 | R114L, R119T | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNAGLRQKHTLTCPSCDSYEKKPPKEFLERFKSLL QKMIHQHLSSRTHGSEDS | 1.65 | 688 |
| IL-21_4873 | D33V, H35P, V53I, K101E, R114A | MRSSPGNMERIVICLMVIFLGTLVHKSSSQGQVRPM IRMRQLIDIVDQLKNYINDLVPEFLPAPEDVETNCE WSAFSCFQKAQLKSANTGNNERIINVSIEKLKRKPP STNAGARQKHRLTCPSCDSYEKKPPKEFLERFKSLL QKMIHQHLSSRTHGSEDS | 1.651 | 689 |
| IL-21_3978 | N70G, Q116K, R119E, L120Y | MRSSPGNMERIVICLMVIFLGTLVHKSSSQGQDRHM IRMRQLIDIVDQLKNYVNDLVPEFLPAPEDVETGCE WSAFSCFQKAQLKSANTGNNERIINVSIKKLKRKPP STNAGRRKKHEYTCPSCDSYEKKPPKEFLERFKSLL QKMIHQHLSSRTHGSEDS | 1.652 | 690 |
| IL-21_4811 | D33N, M36T, V57G, K101E, A112L | MRSSPGNMERIVICLMVIFLGTLVHKSSSQGQNRHT IRMRQLIDIVDQLKNYVNDLGPEFLPAPEDVETNCE WSAFSCFQKAQLKSANTGNNERIINVSIEKLKRKPP STNLGRRQKHRLTCPSCDSYEKKPPKEFLERFKSLL QKMIHQHLSSRTHGSEDS | 1.658 | 691 |
| IL-21_1451 | Y52S, E65Q, N97E, K102Q | MRSSPGNMERIVICLMVIFLGTLVHKSSSQGQDRHM IRMRQLIDIVDQLKNSVNDLVPEFLPAPQDVETNCE WSAFSCFQKAQLKSANTGNNERIIEVSIKQLKRKPP STNAGRRQKHRLTCPSCDSYEKKPPKEFLERFKSLL QKMIHQHLSSRTHGSEDS | 1.661 | 692 |
| IL-21_3360 | N70E, N91E, R119K | MRSSPGNMERIVICLMVIFLGTLVHKSSSQGQDRHM IRMRQLIDIVDQLKNYVNDLVPEFLPAPEDVETECE WSAFSCFQKAQLKSANTGENERIINVSIKKLKRKPP STNAGRRQKHKLTCPSCDSYEKKPPKEFLERFKSLL QKMIHQHLSSRTHGSEDS | 1.662 | 693 |
| IL-21_0160 | K50S, P107I | MRSSPGNMERIVICLMVIFLGTLVHKSSSQGQDRHM IRMRQLIDIVDQLSNYVNDLVPEFLPAPEDVETNCE WSAFSCFQKAQLKSANTGNNERIINVSIKKLKRKIP STNAGRRQKHRLTCPSCDSYEKKPPKEFLERFKSLL QKMIHQHLSSRTHGSEDS | 1.665 | 694 |
| IL-21_2901 | D33N, R115E | MRSSPGNMERIVICLMVIFLGTLVHKSSSQGQNRHM IRMRQLIDIVDQLKNYVNDLVPEFLPAPEDVETNCE WSAFSCFQKAQLKSANTGNNERIINVSIKKLKRKPP STNAGREQKHRLTCPSCDSYEKKPPKEFLERFKSLL QKMIHQHLSSRTHGSEDS | 1.667 | 695 |
| IL-21_3585 | Y52M, S99A, N111T | MRSSPGNMERIVICLMVIFLGTLVHKSSSQGQDRHM IRMRQLIDIVDQLKNMVNDLVPEFLPAPEDVETNCE WSAFSCFQKAQLKSANTGNNERIINVAIKKLKRKPP STTAGRRQKHRLTCPSCDSYEKKPPKEFLERFKSLL QKMIHQHLSSRTHGSEDS | 1.668 | 696 |
| IL-21_3410 | P107L, A112L, R119T | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKLP STNLGRRQKHTLTCPSCDSYEKKPPKEFLERFKSLL QKMIHQHLSSRTHGSEDS | 1.672 | 697 |
| IL-21_2819 | F60L, N111E | MRSSPGNMERIVICLMVIFLGTLVHKSSSQGQDRHM IRMRQLIDIVDQLKNYVNDLVPELLPAPEDVETNCE WSAFSCFQKAQLKSANTGNNERIINVSIKKLKRKPP STEAGRRQKHRLTCPSCDSYEKKPPKEFLERFKSLL QKMIHQHLSSRTHGSEDS | 1.674 | 698 |
| IL-21_1154 | H35V, K50G, A112Q | MRSSPGNMERIVICLMVIFLGTLVHKSSSQGQDRVM IRMRQLIDIVDQLGNYVNDLVPEFLPAPEDVETNCE WSAFSCFQKAQLKSANTGNNERIINVSIKKLKRKPP STNQGRRQKHRLTCPSCDSYEKKPPKEFLERFKSLL QKMIHQHLSSRTHGSEDS | 1.674 | 699 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_2674 | H35T, M36A | MRSSPGNMERIVICLMVIFLGTLVHKSSSQGQDRTA IRMRQLIDIVDQLKNYVNDLVPEFLPAPEDVETNCE WSAFSCFQKAQLKSANTGNNERIINVSIKKLKRKPP STNAGRRQKHRLTCPSCDSYEKKPPKEFLERFKSLL QKMIHQHLSSRTHGSEDS | 1.676 | 700 |
| IL-21_2890 | H35L, S99T | MRSSPGNMERIVICLMVIFLGTLVHKSSSQGQDRLM IRMRQLIDIVDQLKNYVNDLVPEFLPAPEDVETNCE WSAFSCFQKAQLKSANTGNNERIINVTIKKLKRKPP STNAGRRQKHRLTCPSCDSYEKKPPKEFLERFKSLL QKMIHQHLSSRTHGSEDS | 1.676 | 701 |
| IL-21_2238 | Q48S, K50L, P58H, K81N, 195N | MRSSPGNMERIVICLMVIFLGTLVHKSSSQGQDRHM IRMRQLIDIVDSLLNYVNDLVHEFLPAPEDVETNCE WSAFSCFQNAQLKSANTGNNERNINVSIKKLKRKPP STNAGRRQKHRLTCPSCDSYEKKPPKEFLERFKSLL QKMIHQHLSSRTHGSEDS | 1.684 | 702 |
| IL-21_2720 | N111S, R115D | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STSAGRDQKHRLTCPSCDSYEKKPPKEFLERFKSLL QKMIHQHLSSRTHGSEDS | 1.688 | 703 |
| IL-21_3102 | R94Q, L120S | MRSSPGNMERIVICLMVIFLGTLVHKSSSQGQDRHM IRMRQLIDIVDQLKNYVNDLVPEFLPAPEDVETNCE WSAFSCFQKAQLKSANTGNNEQIINVSIKKLKRKPP STNAGRRQKHRSTCPSCDSYEKKPPKEFLERFKSLL QKMIHQHLSSRTHGSEDS | 1.692 | 704 |
| IL-21_1988 | L42M, K50S, S74P, N88I, R114E | MRSSPGNMERIVICLMVIFLGTLVHKSSSQGQDRHM IRMRQMIDIVDQLSNYVNDLVPEFLPAPEDVETNCE WPAFSCFQKAQLKSAITGNNERIINVSIKKLKRKPP STNAGERQKHRLTCPSCDSYEKKPPKEFLERFKSLL QKMIHQHLSSRTHGSEDS | 1.698 | 705 |
| IL-21_3499 | P108D, N111D, H118Q | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPD STDAGRRQKQRLTCPSCDSYEKKPPKEFLERFKSLL QKMIHQHLSSRTHGSEDS | 1.699 | 706 |
| IL-21_0824 | D44S, N51V, K101E | MRSSPGNMERIVICLMVIFLGTLVHKSSSQGQDRHM IRMRQLISIVDQLKVYVNDLVPEFLPAPEDVETNCE WSAFSCFQKAQLKSANTGNNERIINVSIEKLKRKPP STNAGRRQKHRLTCPSCDSYEKKPPKEFLERFKSLL QKMIHQHLSSRTHGSEDS | 1.7 | 707 |
| IL-21_0916 | N51E, N54S, R94N | MRSSPGNMERIVICLMVIFLGTLVHKSSSQGQDRHM IRMRQLIDIVDQLKEYVSDLVPEFLPAPEDVETNCE WSAFSCFQKAQLKSANTGNNENIINVSIKKLKRKPP STNAGRRQKHRLTCPSCDSYEKKPPKEFLERFKSLL QKMIHQHLSSRTHGSEDS | 1.7 | 708 |
| IL-21_0987 | N54E, F60E, N111A | MRSSPGNMERIVICLMVIFLGTLVHKSSSQGQDRHM IRMRQLIDIVDQLKNYVEDLVPEELPAPEDVETNCE WSAFSCFQKAQLKSANTGNNERIINVSIKKLKRKPP STAAGRRQKHRLTCPSCDSYEKKPPKEFLERFKSLL QKMIHQHLSSRTHGSEDS | 1.701 | 709 |
| IL-21_3021 | R114D, T121K | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNAGDRQKHRLKCPSCDSYEKKPPKEFLERFKSLL QKMIHQHLSSRTHGSEDS | 1.706 | 710 |
| IL-21_2917 | H35L, R94K | MRSSPGNMERIVICLMVIFLGTLVHKSSSQGQDRLM IRMRQLIDIVDQLKNYVNDLVPEFLPAPEDVETNCE WSAFSCFQKAQLKSANTGNNEKIINVSIKKLKRKPP STNAGRRQKHRLTCPSCDSYEKKPPKEFLERFKSLL QKMIHQHLSSRTHGSEDS | 1.706 | 711 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_3412 | R40E, I43V, G113D | MRSSPGNMERIVICLMVIFLGTLVHKSSSQGQDRHM IRMEQLVDIVDQLKNYVNDLVPEFLPAPEDVETNCE WSAFSCFQKAQLKSANTGNNERIINVSIKKLKRKPP STNADRRQKHRLTCPSCDSYEKKPPKEFLERFKSLL QKMIHQHLSSRTHGSEDS | 1.708 | 712 |
| IL-21_4136 | H35F, V57Q, T69Q, N111P | MRSSPGNMERIVICLMVIFLGTLVHKSSSQGQDRFM IRMRQLIDIVDQLKNYVNDLQPEFLPAPEDVEQNCE WSAFSCFQKAQLKSANTGNNERIINVSIKKLKRKPP STPAGRRQKHRLTCPSCDSYEKKPPKEFLERFKSLL QKMIHQHLSSRTHGSEDS | 1.712 | 713 |
| IL-21_3472 | H35N, E68K, R115Q | MRSSPGNMERIVICLMVIFLGTLVHKSSSQGQDRNM IRMRQLIDIVDQLKNYVNDLVPEFLPAPEDVKTNCE WSAFSCFQKAQLKSANTGNNERIINVSIKKLKRKPP STNAGRQQKHRLTCPSCDSYEKKPPKEFLERFKSLL QKMIHQHLSSRTHGSEDS | 1.714 | 714 |
| IL-21_1193 | I45T, E65V, R114T | MRSSPGNMERIVICLMVIFLGTLVHKSSSQGQDRHM IRMRQLIDTVDQLKNYVNDLVPEFLPAPVDVETNCE WSAFSCFQKAQLKSANTGNNERIINVSIKKLKRKPP STNAGTRQKHRLTCPSCDSYEKKPPKEFLERFKSLL QKMIHQHLSSRTHGSEDS | 1.715 | 715 |
| IL-21_3934 | Q32F, D33G, S99L, R115A | MRSSPGNMERIVICLMVIFLGTLVHKSSSQGFGRHM IRMRQLIDIVDQLKNYVNDLVPEFLPAPEDVETNCE WSAFSCFQKAQLKSANTGNNERIINVLIKKLKRKPP STNAGRAQKHRLTCPSCDSYEKKPPKEFLERFKSLL QKMIHQHLSSRTHGSEDS | 1.715 | 716 |
| IL-21_0371 | N51H, R114L | MRSSPGNMERIVICLMVIFLGTLVHKSSSQGQDRHM IRMRQLIDIVDQLKHYVNDLVPEFLPAPEDVETNCE WSAFSCFQKAQLKSANTGNNERIINVSIKKLKRKPP STNAGLRQKHRLTCPSCDSYEKKPPKEFLERFKSLL QKMIHQHLSSRTHGSEDS | 1.721 | 717 |
| IL-21_2974 | F76L, H118E | MRSSPGNMERIVICLMVIFLGTLVHKSSSQGQDRHM IRMRQLIDIVDQLKNYVNDLVPEFLPAPEDVETNCE WSALSCFQKAQLKSANTGNNERIINVSIKKLKRKPP STNAGRRQKERLTCPSCDSYEKKPPKEFLERFKSLL QKMIHQHLSSRTHGSEDS | 1.724 | 718 |
| IL-21_3357 | K104S, G113K, R114A | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLSRKPP STNAKARQKHRLTCPSCDSYEKKPPKEFLERFKSLL QKMIHQHLSSRTHGSEDS | 1.725 | 719 |
| IL-21_0045 | N51S, R114I | MRSSPGNMERIVICLMVIFLGTLVHKSSSQGQDRHM IRMRQLIDIVDQLKSYVNDLVPEFLPAPEDVETNCE WSAFSCFQKAQLKSANTGNNERIINVSIKKLKRKPP STNAGIRQKHRLTCPSCDSYEKKPPKEFLERFKSLL QKMIHQHLSSRTHGSEDS | 1.725 | 720 |
| IL-21_2874 | R114G, R115A | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNAGGAQKHRLTCPSCDSYEKKPPKEFLERFKSLL QKMIHQHLSSRTHGSEDS | 1.733 | 721 |
| IL-21_3010 | N111Y, H118D | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STYAGRRQKDRLTCPSCDSYEKKPPKEFLERFKSLL QKMIHQHLSSRTHGSEDS | 1.737 | 722 |
| IL-21_2825 | Q32D, P107T | MRSSPGNMERIVICLMVIFLGTLVHKSSSQGDDRHM IRMRQLIDIVDQLKNYVNDLVPEFLPAPEDVETNCE WSAFSCFQKAQLKSANTGNNERIINVSIKKLKRKTP STNAGRRQKHRLTCPSCDSYEKKPPKEFLERFKSLL QKMIHQHLSSRTHGSEDS | 1.738 | 723 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_4151 | P107T, N111I, R115A, H149N | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKTPSTIAGRAQKHRLTCPSCDSYEKKPPKEFLERFKSLLQKMINQHLSSRTHGSEDS | 1.74 | 724 |
| IL-21_4708 | N111L, R114T, L120V, T121N, L152Y | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTLAGTRQKHRVNCPSCDSYEKKPPKEFLERFKSLLQKMIHQHYSSRTHGSEDS | 1.74 | 725 |
| IL-21_3547 | W73S, N97E, P107L | MRSSPGNMERIVICLMVIFLGTLVHKSSSQGQDRHMIRMRQLIDIVDQLKNYVNDLVPEFLPAPEDVETNCESSAFSCFQKAQLKSANTGNNERIIEVSIKKLKRKLPSTNAGRRQKHRLTCPSCDSYEKKPPKEFLERFKSLLQKMIHQHLSSRTHGSEDS | 1.743 | 726 |
| IL-21_3649 | D33S, A112Y, R115E | MRSSPGNMERIVICLMVIFLGTLVHKSSSQGQSRHMIRMRQLIDIVDQLKNYVNDLVPEFLPAPEDVETNCEWSAFSCFQKAQLKSANTGNNERIINVSIKKLKRKPPSTNYGREQKHRLTCPSCDSYEKKPPKEFLERFKSLLQKMIHQHLSSRTHGSEDS | 1.748 | 727 |
| IL-21_4798 | H35S, I43A, V98G, S991, N111A | MRSSPGNMERIVICLMVIFLGTLVHKSSSQGQDRSMIRMRQLADIVDQLKNYVNDLVPEFLPAPEDVETNCEWSAFSCFQKAQLKSANTGNNERIINGIIKKLKRKPPSTAAGRRQKHRLTCPSCDSYEKKPPKEFLERFKSLLQKMIHQHLSSRTHGSEDS | 1.75 | 728 |
| IL-21_3372 | E65Q, G113S, R114A | MRSSPGNMERIVICLMVIFLGTLVHKSSSQGQDRHMIRMRQLIDIVDQLKNYVNDLVPEFLPAPQDVETNCEWSAFSCFQKAQLKSANTGNNERIINVSIKKLKRKPPSTNASARQKHRLTCPSCDSYEKKPPKEFLERFKSLLQKMIHQHLSSRTHGSEDS | 1.75 | 729 |
| IL-21_2993 | R115G, R119H | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRGQKHHLTCPSCDSYEKKPPKEFLERFKSLLQKMIHQHLSSRTHGSEDS | 1.753 | 730 |
| IL-21_3022 | W73D, R115E | MRSSPGNMERIVICLMVIFLGTLVHKSSSQGQDRHMIRMRQLIDIVDQLKNYVNDLVPEFLPAPEDVETNCEDSAFSCFQKAQLKSANTGNNERIINVSIKKLKRKPPSTNAGREQKHRLTCPSCDSYEKKPPKEFLERFKSLLQKMIHQHLSSRTHGSEDS | 1.754 | 731 |
| IL-21_1322 | R40K, Q41S, F60D, P107D | MRSSPGNMERIVICLMVIFLGTLVHKSSSQGQDRHMIRMKSLIDIVDQLKNYVNDLVPEDLPAPEDVETNCEWSAFSCFQKAQLKSANTGNNERIINVSIKKLKRKDPSTNAGRRQKHRLTCPSCDSYEKKPPKEFLERFKSLLQKMIHQHLSSRTHGSEDS | 1.754 | 732 |
| IL-21_3563 | Q32E, N70H, P107M | MRSSPGNMERIVICLMVIFLGTLVHKSSSQGEDRHMIRMRQLIDIVDQLKNYVNDLVPEFLPAPEDVETHCEWSAFSCFQKAQLKSANTGNNERIINVSIKKLKRKMPSTNAGRRQKHRLTCPSCDSYEKKPPKEFLERFKSLLQKMIHQHLSSRTHGSEDS | 1.755 | 733 |
| IL-21_0317 | I45T, R115N | MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSTNAGRNQKHRLTCPSCDSYEKKPPKEFLERFKSLLQKMIHQHLSSRTHGSEDS | 1.756 | 734 |
| IL-21_4234 | N91S, S109P, R114P, T121S | MRSSPGNMERIVICLMVIFLGTLVHKSSSQGQDRHMIRMRQLIDIVDQLKNYVNDLVPEFLPAPEDVETNCEWSAFSCFQKAQLKSANTGSNERIINVSIKKLKRKPPPTNAGPRQKHRLSCPSCDSYEKKPPKEFLERFKSLLQKMIHQHLSSRTHGSEDS | 1.756 | 735 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_3385 | N70E, R94A, G113K | MRSSPGNMERIVICLMVIFLGTLVHKSSSQGQDRHMIRMRQLIDIVDQLKNYVNDLVPEFLPAPEDVETECEWSAFSCFQKAQLKSANTGNNEAIINVSIKKLKRKPPSTNAKRRQKHRLTCPSCDSYEKKPPKEFLERFKSLLQKMIHQHLSSRTHGSEDS | 1.76 | 736 |
| IL-21_0287 | D44H, R94D | MRSSPGNMERIVICLMVIFLGTLVHKSSSQGQDRHMIRMRQLIHIVDQLKNYVNDLVPEFLPAPEDVETNCEWSAFSCFQKAQLKSANTGNNEDIINVSIKKLKRKPPSTNAGRRQKHRLTCPSCDSYEKKPPKEFLERFKSLLQKMIHQHLSSRTHGSEDS | 1.768 | 737 |
| IL-21_0711 | H35F, N51S, D66S | MRSSPGNMERIVICLMVIFLGTLVHKSSSQGQDRFMIRMRQLIDIVDQLKSYVNDLVPEFLPAPESVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 1.772 | 738 |
| IL-21_3090 | R115G, L152Q | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRGQKHRLTCPSCDSYEKKPPKEFLERFKSLLQKMIHQHQSSRTHGSEDS | 1.774 | 739 |
| IL-21_2946 | N111K, R115D | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTKAGRDQKHRLTCPSCDSYEKKPPKEFLERFKSLLQKMIHQHLSSRTHGSEDS | 1.776 | 740 |
| IL-21_2980 | Q32L, V98Q | MRSSPGNMERIVICLMVIFLGTLVHKSSSQGLDRHMIRMRQLIDIVDQLKNYVNDLVPEFLPAPEDVETNCEWSAFSCFQKAQLKSANTGNNERIINQSIKKLKRKPPSTNAGRRQKHRLTCPSCDSYEKKPPKEFLERFKSLLQKMIHQHLSSRTHGSEDS | 1.78 | 741 |
| IL-21_3605 | V98I, S109A, G113E | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINISIKKLKRKPPATNAERRQKHRLTCPSCDSYEKKPPKEFLERFKSLLQKMIHQHLSSRTHGSEDS | 1.782 | 742 |
| IL-21_4005 | Q32L, H35F, T69R, R94A | MRSSPGNMERIVICLMVIFLGTLVHKSSSQGLDREMIRMRQLIDIVDQLKNYVNDLVPEFLPAPEDVERNCEWSAFSCFQKAQLKSANTGNNEAIINVSIKKLKRKPPSTNAGRRQKHRLTCPSCDSYEKKPPKEFLERFKSLLQKMIHQHLSSRTHGSEDS | 1.783 | 743 |
| IL-21_0681 | Q32D, N51S, K106T | MRSSPGNMERIVICLMVIFLGTLVHKSSSQGDDRHMIRMRQLIDIVDQLKSYVNDLVPEFLPAPEDVETNCEWSAFSCFQKAQLKSANTGNNERIINVSIKKLKRTPPSTNAGRRQKHRLTCPSCDSYEKKPPKEFLERFKSLLQKMIHQHLSSRTHGSEDS | 1.784 | 744 |
| IL-21_2740 | V57D, G113D | MRSSPGNMERIVICLMVIFLGTLVHKSSSQGQDRHMIRMRQLIDIVDQLKNYVNDLDPEFLPAPEDVETNCEWSAFSCFQKAQLKSANTGNNERIINVSIKKLKRKPPSTNADRRQKHRLTCPSCDSYEKKPPKEFLERFKSLLQKMIHQHLSSRTHGSEDS | 1.784 | 745 |
| IL-21_4208 | H35A, W73L, N91T, P107L | MRSSPGNMERIVICLMVIFLGTLVHKSSSQGQDRAMIRMRQLIDIVDQLKNYVNDLVPEFLPAPEDVETNCELSAFSCFQKAQLKSANTGTNERIINVSIKKLKRKLPSTNAGRRQKHRLTCPSCDSYEKKPPKEFLERFKSLLQKMIHQHLSSRTHGSEDS | 1.796 | 746 |
| IL-21_2995 | N111T, R115A | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTTAGRAQKHRLTCPSCDSYEKKPPKEFLERFKSLLQKMIHQHLSSRTHGSEDS | 1.803 | 747 |

TABLE 9-continued

| Variant Name | Mutations | Amino Acid Sequence | Predicted Affinity | SEQ ID NO |
|---|---|---|---|---|
| Protein Expression Yields and Purity for Stabilized IL-21-Fc Fusion Proteins | | | | |
| IL-21_1847 | D44T, V98D, K106R, G113L | MRSSPGNMERIVICLMVIFLGTLVHKSSSQGQDRHM IRMRQLITIVDQLKNYVNDLVPEFLPAPEDVETNCE WSAFSCFQKAQLKSANTGNNERIINDSIKKLKRRPP STNALRRQKHRLTCPSCDSYEKKPPKEFLERFKSLL QKMIHQHLSSRTHGSEDS | 1.808 | 748 |
| IL-21_3079 | T89A, H118D | MRSSPGNMERIVICLMVIFLGTLVHKSSSQGQDRHM IRMRQLIDIVDQLKNYVNDLVPEFLPAPEDVETNCE WSAFSCFQKAQLKSANAGNNERIINVSIKKLKRKPP STNAGRRQKDRLTCPSCDSYEKKPPKEFLERFKSLL QKMIHQHLSSRTHGSEDS | 1.809 | 749 |
| IL-21_1034 | N51H, T69L, R114A | MRSSPGNMERIVICLMVIFLGTLVHKSSSQGQDRHM IRMRQLIDIVDQLKHYVNDLVPEFLPAPEDVELNCE WSAFSCFQKAQLKSANTGNNERIINVSIKKLKRKPP STNAGARQKHRLTCPSCDSYEKKPPKEFLERFKSLL QKMIHQHLSSRTHGSEDS | 1.811 | 750 |
| IL-21_3490 | W73Y, R94T, R114L | MRSSPGNMERIVICLMVIFLGTLVHKSSSQGQDRHM IRMRQLIDIVDQLKNYVNDLVPEFLPAPEDVETNCE YSAFSCFQKAQLKSANTGNNETIINVSIKKLKRKPP STNAGLRQKHRLTCPSCDSYEKKPPKEFLERFKSLL QKMIHQHLSSRTHGSEDS | 1.812 | 751 |
| IL-21_2713 | Q32N, R114A | MRSSPGNMERIVICLMVIFLGTLVHKSSSQGNDRHM IRMRQLIDIVDQLKNYVNDLVPEFLPAPEDVETNCE WSAFSCFQKAQLKSANTGNNERIINVSIKKLKRKPP STNAGARQKHRLTCPSCDSYEKKPPKEFLERFKSLL QKMIHQHLSSRTHGSEDS | 1.815 | 752 |
| IL-21_4193 | M36V, R38H, E68L, R114A | MRSSPGNMERIVICLMVIFLGTLVHKSSSQGQDRHV IHMRQLIDIVDQLKNYVNDLVPEFLPAPEDVLTNCE WSAFSCFQKAQLKSANTGNNERIINVSIKKLKRKPP STNAGARQKHRLTCPSCDSYEKKPPKEFLERFKSLL QKMIHQHLSSRTHGSEDS | 1.816 | 753 |
| IL-21_4147 | R40E, N97D, P107Y, N111I | MRSSPGNMERIVICLMVIFLGTLVHKSSSQGQDRHM IRMEQLIDIVDQLKNYVNDLVPEFLPAPEDVETNCE WSAFSCFQKAQLKSANTGNNERIIDVSIKKLKRKYP STIAGRRQKHRLTCPSCDSYEKKPPKEFLERFKSLL QKMIHQHLSSRTHGSEDS | 1.817 | 754 |
| IL-21_3613 | P58T, P107L, R114N | MRSSPGNMERIVICLMVIFLGTLVHKSSSQGQDRHM IRMRQLIDIVDQLKNYVNDLVTEFLPAPEDVETNCE WSAFSCFQKAQLKSANTGNNERIINVSIKKLKRKLP STNAGNRQKHRLTCPSCDSYEKKPPKEFLERFKSLL QKMIHQHLSSRTHGSEDS | 1.822 | 755 |
| IL-21_2971 | Q32D, R40L | MRSSPGNMERIVICLMVIFLGTLVHKSSSQGDDRHM IRMLQLIDIVDQLKNYVNDLVPEFLPAPEDVETNCE WSAFSCFQKAQLKSANTGNNERIINVSIKKLKRKPP STNAGRRQKHRLTCPSCDSYEKKPPKEFLERFKSLL QKMIHQHLSSRTHGSEDS | 1.822 | 756 |
| IL-21_4044 | W73P, K106F, S109P, R114A | MRSSPGNMERIVICLMVIFLGTLVHKSSSQGQDRHM IRMRQLIDIVDQLKNYVNDLVPEFLPAPEDVETNCE PSAFSCFQKAQLKSANTGNNERIINVSIKKLKRFPP PTNAGARQKHRLTCPSCDSYEKKPPKEFLERFKSLL QKMIHQHLSSRTHGSEDS | 1.823 | 757 |
| IL-21_2772 | E72L, R115G | MRSSPGNMERIVICLMVIFLGTLVHKSSSQGQDRHM IRMRQLIDIVDQLKNYVNDLVPEFLPAPEDVETNCL WSAFSCFQKAQLKSANTGNNERIINVSIKKLKRKPP STNAGRGQKHRLTCPSCDSYEKKPPKEFLERFKSLL QKMIHQHLSSRTHGSEDS | 1.826 | 758 |
| IL-21_0576 | Q48E, N54S | MRSSPGNMERIVICLMVIFLGTLVHKSSSQGQDRHM IRMRQLIDIVDELKNYVSDLVPEFLPAPEDVETNCE WSAFSCFQKAQLKSANTGNNERIINVSIKKLKRKPP STNAGRRQKHRLTCPSCDSYEKKPPKEFLERFKSLL QKMIHQHLSSRTHGSEDS | 1.826 | 759 |

TABLE 9-continued

| Protein Expression Yields and Purity for Stabilized IL-21-Fc Fusion Proteins | | | | |
|---|---|---|---|---|
| Variant Name | Mutations | Amino Acid Sequence | Predicted Affinity | SEQ ID NO |
| IL-21_0308 | I45T, Q48E | MRSSPGNMERIVICLMVIFLGTLVHKSSSQGQDRHM IRMRQLIDTVDELKNYVNDLVPEFLPAPEDVETNCE WSAFSCFQKAQLKSANTGNNERIINVSIKKLKRKPP STNAGRRQKHRLTCPSCDSYEKKPPKEFLERFKSLL QKMIHQHLSSRTHGSEDS | 1.826 | 760 |
| IL-21_2978 | R119K, T121D | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNAGRRQKHKLDCPSCDSYEKKPPKEFLERFKSLL QKMIHQHLSSRTHGSEDS | 1.833 | 761 |
| IL-21_3512 | R40A, V57E, R115K | MRSSPGNMERIVICLMVIFLGTLVHKSSSQGQDRHM IRMAQLIDIVDQLKNYVNDLEPEFLPAPEDVETNCE WSAFSCFQKAQLKSANTGNNERIINVSIKKLKRKPP STNAGRKQKHRLTCPSCDSYEKKPPKEFLERFKSLL QKMIHQHLSSRTHGSEDS | 1.833 | 762 |
| IL-21_2770 | R114A, Q116S | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNAGARSKHRLTCPSCDSYEKKPPKEFLERFKSLL QKMIHQHLSSRTHGSEDS | 1.838 | 763 |
| IL-21_2802 | N111Y, R115G | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STYAGRGQKHRLTCPSCDSYEKKPPKEFLERFKSLL QKMIHQHLSSRTHGSEDS | 1.845 | 764 |
| IL-21_4103 | Q32A, H35F, V46I, D47E | MRSSPGNMERIVICLMVIFLGTLVHKSSSQGADREM IRMRQLIDIIEQLKNYVNDLVPEFLPAPEDVETNCE WSAFSCFQKAQLKSANTGNNERIINVSIKKLKRKPP STNAGRRQKHRLTCPSCDSYEKKPPKEFLERFKSLL QKMIHQHLSSRTHGSEDS | 1.852 | 765 |
| IL-21_2899 | R114V, L120S | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNAGVRQKHRSTCPSCDSYEKKPPKEFLERFKSLL QKMIHQHLSSRTHGSEDS | 1.86 | 766 |
| IL-21_3508 | R40S, I43L, R115E | MRSSPGNMERIVICLMVIFLGTLVHKSSSQGQDRHM IRMSQLLDIVDQLKNYVNDLVPEFLPAPEDVETNCE WSAFSCFQKAQLKSANTGNNERIINVSIKKLKRKPP STNAGREQKHRLTCPSCDSYEKKPPKEFLERFKSLL QKMIHQHLSSRTHGSEDS | 1.866 | 767 |
| IL-21_2753 | H35S, K102L | MRSSPGNMERIVICLMVIFLGTLVHKSSSQGQDRSM IRMRQLIDIVDQLKNYVNDLVPEFLPAPEDVETNCE WSAFSCFQKAQLKSANTGNNERIINVSIKLLKRKPP STNAGRRQKHRLTCPSCDSYEKKPPKEFLERFKSLL QKMIHQHLSSRTHGSEDS | 1.867 | 768 |
| IL-21_3702 | P107L, S109I, T121P | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKLP ITNAGRRQKHRLPCPSCDSYEKKPPKEFLERFKSLL QKMIHQHLSSRTHGSEDS | 1.869 | 769 |
| IL-21_3665 | R38A, V57E, R114D | MRSSPGNMERIVICLMVIFLGTLVHKSSSQGQDRHM IAMRQLIDIVDQLKNYVNDLEPEFLPAPEDVETNCE WSAFSCFQKAQLKSANTGNNERIINVSIKKLKRKPP STNAGDRQKHRLTCPSCDSYEKKPPKEFLERFKSLL QKMIHQHLSSRTHGSEDS | 1.869 | 770 |
| IL-21_4304 | H35Q, M36E, V53L, P107I | MRSSPGNMERIVICLMVIFLGTLVHKSSSQGQDRQE IRMRQLIDIVDQLKNYLNDLVPEFLPAPEDVETNCE WSAFSCFQKAQLKSANTGNNERIINVSIKKLKRKIP STNAGRRQKHRLTCPSCDSYEKKPPKEFLERFKSLL QKMIHQHLSSRTHGSEDS | 1.87 | 771 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_3080 | S77A, R114S | MRSSPGNMERIVICLMVIFLGTLVHKSSSQGQDRHM<br>IRMRQLIDIVDQLKNYVNDLVPEFLPAPEDVETNCE<br>WSAFACFQKAQLKSANTGNNERIINVSIKKLKRKPP<br>STNAGSRQKHRLTCPSCDSYEKKPPKEFLERFKSLL<br>QKMIHQHLSSRTHGSEDS | 1.87 | 772 |
| IL-21_2816 | T69R, R94Q | MRSSPGNMERIVICLMVIFLGTLVHKSSSQGQDRHM<br>IRMRQLIDIVDQLKNYVNDLVPEFLPAPEDVERNCE<br>WSAFSCFQKAQLKSANTGNNEQIINVSIKKLKRKPP<br>STNAGRRQKHRLTCPSCDSYEKKPPKEFLERFKSLL<br>QKMIHQHLSSRTHGSEDS | 1.873 | 773 |
| IL-21_1632 | I45T, K81N, R94Q, S109K | MRSSPGNMERIVICLMVIFLGTLVHKSSSQGQDRHM<br>IRMRQLIDTVDQLKNYVNDLVPEFLPAPEDVETNCE<br>WSAFSCFQNAQLKSANTGNNEQIINVSIKKLKRKPP<br>KTNAGRRQKHRLTCPSCDSYEKKPPKEFLERFKSLL<br>QKMIHQHLSSRTHGSEDS | 1.876 | 774 |
| IL-21_3361 | R40M, V57E, G113N | MRSSPGNMERIVICLMVIFLGTLVHKSSSQGQDRHM<br>IRMMQLIDIVDQLKNYVNDLEPEFLPAPEDVETNCE<br>WSAFSCFQKAQLKSANTGNNERIINVSIKKLKRKPP<br>STNANRRQKHRLTCPSCDSYEKKPPKEFLERFKSLL<br>QKMIHQHLSSRTHGSEDS | 1.877 | 775 |
| IL-21_3036 | T89A, R94T | MRSSPGNMERIVICLMVIFLGTLVHKSSSQGQDRHM<br>IRMRQLIDIVDQLKNYVNDLVPEFLPAPEDVETNCE<br>WSAFSCFQKAQLKSANAGNNETIINVSIKKLKRKPP<br>STNAGRRQKHRLTCPSCDSYEKKPPKEFLERFKSLL<br>QKMIHQHLSSRTHGSEDS | 1.877 | 776 |
| IL-21_2956 | R115K, T121E | MRSSPGNMERIVICLMVIFLGTLVHKSSSQGQDRHM<br>IRMRQLIDIVDQLKNYVNDLVPEFLPAPEDVETNCE<br>WSAFSCFQKAQLKSANTGNNERIINVSIKKLKRKPP<br>STNAGRKQKHRLECPSCDSYEKKPPKEFLERFKSLL<br>QKMIHQHLSSRTHGSEDS | 1.883 | 777 |
| IL-21_4669 | N70G, T89P, N97K, S99L, K102A | MRSSPGNMERIVICLMVIFLGTLVHKSSSQGQDRHM<br>IRMRQLIDIVDQLKNYVNDLVPEFLPAPEDVETGCE<br>WSAFSCFQKAQLKSANPGNNERIIKVLIKALKRKPP<br>STNAGRRQKHRLTCPSCDSYEKKPPKEFLERFKSLL<br>QKMIHQHLSSRTHGSEDS | 1.885 | 778 |
| IL-21_2869 | N70H, R114I | MRSSPGNMERIVICLMVIFLGTLVHKSSSQGQDRHM<br>IRMRQLIDIVDQLKNYVNDLVPEFLPAPEDVETHCE<br>WSAFSCFQKAQLKSANTGNNERIINVSIKKLKRKPP<br>STNAGIRQKHRLTCPSCDSYEKKPPKEFLERFKSLL<br>QKMIHQHLSSRTHGSEDS | 1.887 | 779 |
| IL-21_4283 | D33F, H35F, S74A, Q83E | MRSSPGNMERIVICLMVIFLGTLVHKSSSQGQFRFM<br>IRMRQLIDIVDQLKNYVNDLVPEFLPAPEDVETNCE<br>WAAFSCFQKAELKSANTGNNERIINVSIKKLKRKPP<br>STNAGRRQKHRLTCPSCDSYEKKPPKEFLERFKSLL<br>QKMIHQHLSSRTHGSEDS | 1.89 | 780 |
| IL-21_1359 | K50S, E59D, K106S, T110N | MRSSPGNMERIVICLMVIFLGTLVHKSSSQGQDRHM<br>IRMRQLIDIVDQLSNYVNDLVPDELPAPEDVETNCE<br>WSAFSCFQKAQLKSANTGNNERIINVSIKKLKRSPP<br>SNNAGRRQKHRLTCPSCDSYEKKPPKEFLERFKSLL<br>QKMIHQHLSSRTHGSEDS | 1.892 | 781 |
| IL-21_4189 | Q32V, F60Q, A112E, G113N | MRSSPGNMERIVICLMVIFLGTLVHKSSSQGVDRHM<br>IRMRQLIDIVDQLKNYVNDLVPEQLPAPEDVETNCE<br>WSAFSCFQKAQLKSANTGNNERIINVSIKKLKRKPP<br>STNENRRQKHRLTCPSCDSYEKKPPKEFLERFKSLL<br>QKMIHQHLSSRTHGSEDS | 1.902 | 782 |
| IL-21_3087 | R114G, Q116Y | MRSSPGNMERIVICLMVIFLGTLVHKSSSQGQDRHM<br>IRMRQLIDIVDQLKNYVNDLVPEFLPAPEDVETNCE<br>WSAFSCFQKAQLKSANTGNNERIINVSIKKLKRKPP<br>STNAGGRYKHRLTCPSCDSYEKKPPKEFLERFKSLL<br>QKMIHQHLSSRTHGSEDS | 1.909 | 783 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_2796 | V57G, R114G | MRSSPGNMERIVICLMVIFLGTLVHKSSSQGQDRHMIRMRQLIDIVDQLKNYVNDLGPEFLPAPEDVETNCEWSAFSCFQKAQLKSANTGNNERIINVSIKKLKRKPPSTNAGGRQKHRLTCPSCDSYEKKPPKEFLERFKSLLQKMIHQHLSSRTHGSEDS | 1.91 | 784 |
| IL-21_2880 | P107E, R114A | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKEPSTNAGARQKHRLTCPSCDSYEKKPPKEFLERFKSLLQKMIHQHLSSRTHGSEDS | 1.916 | 785 |
| IL-21_1585 | Q32L, R34P, I45E, R114Y | MRSSPGNMERIVICLMVIFLGTLVHKSSSQGLDPHMIRMRQLIDEVDQLKNYVNDLVPEFLPAPEDVETNCEWSAFSCFQKAQLKSANTGNNERIINVSIKKLKRKPPSTNAGYRQKHRLTCPSCDSYEKKPPKEFLERFKSLLQKMIHQHLSSRTHGSEDS | 1.917 | 786 |
| IL-21_3602 | R40T, N70H, R115F | MRSSPGNMERIVICLMVIFLGTLVHKSSSQGQDRHMIRMTQLIDIVDQLKNYVNDLVPEFLPAPEDVETHCEWSAFSCFQKAQLKSANTGNNERIINVSIKKLKRKPPSTNAGRFQKHRLTCPSCDSYEKKPPKEFLERFKSLLQKMIHQHLSSRTHGSEDS | 1.917 | 787 |
| IL-21_2820 | W73L, P107L | MRSSPGNMERIVICLMVIFLGTLVHKSSSQGQDRHMIRMRQLIDIVDQLKNYVNDLVPEFLPAPEDVETNCELSAFSCFQKAQLKSANTGNNERIINVSIKKLKRKLPSTNAGRRQKHRLTCPSCDSYEKKPPKEFLERFKSLLQKMIHQHLSSRTHGSEDS | 1.918 | 788 |
| IL-21_4092 | R40L, Y52V, T69R, R114Q | MRSSPGNMERIVICLMVIFLGTLVHKSSSQGQDRHMIRMLQLIDIVDQLKNVVNDLVPEFLPAPEDVERNCEWSAFSCFQKAQLKSANTGNNERIINVSIKKLKRKPPSTNAGQRQKHRLTCPSCDSYEKKPPKEFLERFKSLLQKMIHQHLSSRTHGSEDS | 1.92 | 789 |
| IL-21_3345 | N111P, G113T, T121E | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTPATRRQKHRLECPSCDSYEKKPPKEFLERFKSLLQKMIHQHLSSRTHGSEDS | 1.925 | 790 |
| IL-21_2893 | Q32S, N111E | MRSSPGNMERIVICLMVIFLGTLVHKSSSQGSDRHMIRMRQLIDIVDQLKNYVNDLVPEFLPAPEDVETNCEWSAFSCFQKAQLKSANTGNNERIINVSIKKLKRKPPSTEAGRRQKHRLTCPSCDSYEKKPPKEFLERFKSLLQKMIHQHLSSRTHGSEDS | 1.927 | 791 |
| IL-21_4771 | M36V, Y52M, S99T, N111L, R115Q | MRSSPGNMERIVICLMVIFLGTLVHKSSSQGQDRHVIRMRQLIDIVDQLKNMVNDLVPEFLPAPEDVETNCEWSAFSCFQKAQLKSANTGNNERIINVTIKKLKRKPPSTLAGRQQKHRLTCPSCDSYEKKPPKEFLERFKSLLQKMIHQHLSSRTHGSEDS | 1.927 | 792 |
| IL-21_1690 | K50G, T89L, G113M, R114Y | MRSSPGNMERIVICLMVIFLGTLVHKSSSQGQDRHMIRMRQLIDIVDQLGNYVNDLVPEFLPAPEDVETNCEWSAFSCFQKAQLKSANLGNNERIINVSIKKLKRKPPSTNAMYRQKHRLTCPSCDSYEKKPPKEFLERFKSLLQKMIHQHLSSRTHGSEDS | 1.93 | 793 |
| IL-21_2826 | S109T, R114A | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPTTNAGARQKHRLTCPSCDSYEKKPPKEFLERFKSLLQKMIHQHLSSRTHGSEDS | 1.933 | 794 |
| IL-21_2795 | D33E, N97D | MRSSPGNMERIVICLMVIFLGTLVHKSSSQGQERHMIRMRQLIDIVDQLKNYVNDLVPEFLPAPEDVETNCEWSAFSCFQKAQLKSANTGNNERIIDVSIKKLKRKPPSTNAGRRQKHRLTCPSCDSYEKKPPKEFLERFKSLLQKMIHQHLSSRTHGSEDS | 1.934 | 795 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_0515 | V53S, K101Q | MRSSPGNMERIVICLMVIFLGTLVHKSSSQGQDRHMIRMRQLIDIVDQLKNYSNDLVPEFLPAPEDVETNCEWSAFSCFQKAQLKSANTGNNERIINVSIQKLKRKPPSTNAGRRQKHRLTCPSCDSYEKKPPKEFLERFKSLLQKMIHQHLSSRTHGSEDS | 1.938 | 796 |
| IL-21_3362 | E72L, N111M, R114A | MRSSPGNMERIVICLMVIFLGTLVHKSSSQGQDRHMIRMRQLIDIVDQLKNYVNDLVPEFLPAPEDVETNCLWSAFSCFQKAQLKSANTGNNERIINVSIKKLKRKPPSTMAGARQKHRLTCPSCDSYEKKPPKEFLERFKSLLQKMIHQHLSSRTHGSEDS | 1.942 | 797 |
| IL-21_4615 | M36P, E68A, E72L, R114D, R115I | MRSSPGNMERIVICLMVIFLGTLVHKSSSQGQDRHPIRMRQLIDIVDQLKNYVNDLVPEFLPAPEDVATNCLWSAFSCFQKAQLKSANTGNNERIINVSIKKLKRKPPSTNAGDIQKHRLTCPSCDSYEKKPPKEFLERFKSLLQKMIHQHLSSRTHGSEDS | 1.944 | 798 |
| IL-21_2738 | S109A, R114A | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPATNAGARQKHRLTCPSCDSYEKKPPKEFLERFKSLLQKMIHQHLSSRTHGSEDS | 1.946 | 799 |
| IL-21_3503 | V98T, K106P, H118Q | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINTSIKKLKRPPPSTNAGRRQKQRLTCPSCDSYEKKPPKEFLERFKSLLQKMIHQHLSSRTHGSEDS | 1.947 | 800 |
| IL-21_3474 | N97E, G113E, Q116K | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIIEVSIKKLKRKPPSTNAERRKKHRLTCPSCDSYEKKPPKEFLERFKSLLQKMIHQHLSSRTHGSEDS | 1.948 | 801 |
| IL-21_0777 | K50S, L61M, A112V | MRSSPGNMERIVICLMVIFLGTLVHKSSSQGQDRHMIRMRQLIDIVDQLSNYVNDLVPEEMPAPEDVETNCEWSAFSCFQKAQLKSANTGNNERIINVSIKKLKRKPPSTNVGRRQKHRLTCPSCDSYEKKPPKEFLERFKSLLQKMIHQHLSSRTHGSEDS | 1.952 | 802 |
| IL-21_3424 | P58V, N91E, P107L | MRSSPGNMERIVICLMVIFLGTLVHKSSSQGQDRHMIRMRQLIDIVDQLKNYVNDLVVEFLPAPEDVETNCEWSAFSCFQKAQLKSANTGENERIINVSIKKLKRKLPSTNAGRRQKHRLTCPSCDSYEKKPPKEFLERFKSLLQKMIHQHLSSRTHGSEDS | 1.954 | 803 |
| IL-21_3001 | Q32P, H35G | MRSSPGNMERIVICLMVIFLGTLVHKSSSQGPDRGMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 1.969 | 804 |
| IL-21_4801 | N70S, N111G, A112G, R114G, K134L | MRSSPGNMERIVICLMVIFLGTLVHKSSSQGQDRHMIRMRQLIDIVDQLKNYVNDLVPEFLPAPEDVETSCEWSAFSCFQKAQLKSANTGNNERIINVSIKKLKRKPPSTGGGGRQKHRLTCPSCDSYEKKPPLEFLERFKSLLQKMIHQHLSSRTHGSEDS | 1.969 | 805 |
| IL-21_3992 | Q32F, M36I, E59D, N111P | MRSSPGNMERIVICLMVIFLGTLVHKSSSQGEDRHIIRMRQLIDIVDQLKNYVNDLVPDELPAPEDVETNCEWSAFSCFQKAQLKSANTGNNERIINVSIKKLKRKPPSTPAGRRQKHRLTCPSCDSYEKKPPKEFLERFKSLLQKMIHQHLSSRTHGSEDS | 1.97 | 806 |
| IL-21_3431 | I37M, T69R, R114E | MRSSPGNMERIVICLMVIFLGTLVHKSSSQGQDRHMMRMRQLIDIVDQLKNYVNDLVPEFLPAPEDVERNCEWSAFSCFQKAQLKSANTGNNERIINVSIKKLKRKPPSTNAGERQKHRLTCPSCDSYEKKPPKEFLERFKSLLQKMIHQHLSSRTHGSEDS | 1.972 | 807 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_3664 | A82G, S99A, T121Q | MRSSPGNMERIVICLMVIFLGTLVHKSSSQGQDRHM IRMRQLIDIVDQLKNYVNDLVPEFLPAPEDVETNCE WSAFSCFQKGQLKSANTGNNERIINVAIKKLKRKPP STNAGRRQKHRLQCPSCDSYEKKPPKEFLERFKSLL QKMIHQHLSSRTHGSEDS | 1.974 | 808 |
| IL-21_1415 | R40K, I45S, K81G, R115T | MRSSPGNMERIVICLMVIFLGTLVHKSSSQGQDRHM IRMKQLIDSVDQLKNYVNDLVPEFLPAPEDVETNCE WSAFSCFQGAQLKSANTGNNERIINVSIKKLKRKPP STNAGRTQKHRLTCPSCDSYEKKPPKEFLERFKSLL QKMIHQHLSSRTHGSEDS | 1.975 | 809 |
| IL-21_3436 | T69K, S99L, N111M | MRSSPGNMERIVICLMVIFLGTLVHKSSSQGQDRHM IRMRQLIDIVDQLKNYVNDLVPEFLPAPEDVEKNCE WSAFSCFQKAQLKSANTGNNERIINVLIKKLKRKPP STMAGRRQKHRLTCPSCDSYEKKPPKEFLERFKSLL QKMIHQHLSSRTHGSEDS | 1.982 | 810 |
| IL-21_3651 | S77L, R114A, L120Y | MRSSPGNMERIVICLMVIFLGTLVHKSSSQGQDRHM IRMRQLIDIVDQLKNYVNDLVPEFLPAPEDVETNCE WSAFLCFQKAQLKSANTGNNERIINVSIKKLKRKPP STNAGARQKHRYTCPSCDSYEKKPPKEFLERFKSLL QKMIHQHLSSRTHGSEDS | 1.987 | 811 |
| IL-21_2884 | V57D, T89G | MRSSPGNMERIVICLMVIFLGTLVHKSSSQGQDRHM IRMRQLIDIVDQLKNYVNDLDPEFLPAPEDVETNCE WSAFSCFQKAQLKSANGGNNERIINVSIKKLKRKPP STNAGRRQKHRLTCPSCDSYEKKPPKEFLERFKSLL QKMIHQHLSSRTHGSEDS | 1.987 | 812 |
| IL-21_0107 | K50S, E59D | MRSSPGNMERIVICLMVIFLGTLVHKSSSQGQDRHM IRMRQLIDIVDQLSNYVNDLVPDELPAPEDVETNCE WSAFSCFQKAQLKSANTGNNERIINVSIKKLKRKPP STNAGRRQKHRLTCPSCDSYEKKPPKEFLERFKSLL QKMIHQHLSSRTHGSEDS | 1.99 | 813 |
| IL-21_1384 | H35L, I43S, P108I, R114E | MRSSPGNMERIVICLMVIFLGTLVHKSSSQGQDRLM IRMRQLSDIVDQLKNYVNDLVPEFLPAPEDVETNCE WSAFSCFQKAQLKSANTGNNERIINVSIKKLKRKPI STNAGERQKHRLTCPSCDSYEKKPPKEFLERFKSLL QKMIHQHLSSRTHGSEDS | 1.995 | 814 |
| IL-21_0377 | N51H, S74E | MRSSPGNMERIVICLMVIFLGTLVHKSSSQGQDRHM IRMRQLIDIVDQLKHYVNDLVPEFLPAPEDVETNCE WEAFSCFQKAQLKSANTGNNERIINVSIKKLKRKPP STNAGRRQKHRLTCPSCDSYEKKPPKEFLERFKSLL QKMIHQHLSSRTHGSEDS | 1.998 | 815 |
| IL-21_4192 | H35Q, Y52M, N70E, N91G | MRSSPGNMERIVICLMVIFLGTLVHKSSSQGQDRQM IRMRQLIDIVDQLKNMVNDLVPEFLPAPEDVETECE WSAFSCFQKAQLKSANTGGNERIINVSIKKLKRKPP STNAGRRQKHRLTCPSCDSYEKKPPKEFLERFKSLL QKMIHQHLSSRTHGSEDS | 1.999 | 816 |
| IL-21_3711 | Q32V, D33V, K102E | MRSSPGNMERIVICLMVIFLGTLVHKSSSQGVVRHM IRMRQLIDIVDQLKNYVNDLVPEFLPAPEDVETNCE WSAFSCFQKAQLKSANTGNNERIINVSIKELKRKPP STNAGRRQKHRLTCPSCDSYEKKPPKEFLERFKSLL QKMIHQHLSSRTHGSEDS | 2 | 817 |
| IL-21_0050 | I45T, F60Q | MRSSPGNMERIVICLMVIFLGTLVHKSSSQGQDRHM IRMRQLIDTVDQLKNYVNDLVPEQLPAPEDVETNCE WSAFSCFQKAQLKSANTGNNERIINVSIKKLKRKPP STNAGRRQKHRLTCPSCDSYEKKPPKEFLERFKSLL QKMIHQHLSSRTHGSEDS | 2.001 | 818 |
| IL-21_4871 | R40K, V57M, K81R, V98I, P107I | MRSSPGNMERIVICLMVIFLGTLVHKSSSQGQDRHM IRMKQLIDIVDQLKNYVNDLMPEFLPAPEDVETNCE WSAFSCFQRAQLKSANTGNNERIINISIKKLKRKIP STNAGRRQKHRLTCPSCDSYEKKPPKEFLERFKSLL QKMIHQHLSSRTHGSEDS | 2.01 | 819 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_2875 | H35S, V98G | MRSSPGNMERIVICLMVIFLGTLVHKSSSQGQDRSM IRMRQLIDIVDQLKNYVNDLVPEFLPAPEDVETNCE WSAFSCFQKAQLKSANTGNNERIINGSIKKLKRKPP STNAGRRQKHRLTCPSCDSYEKKPPKEFLERFKSLL QKMIHQHLSSRTHGSEDS | 2.016 | 820 |
| IL-21_2664 | S99T, H118Q | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVTIKKLKRKPP STNAGRRQKQRLTCPSCDSYEKKPPKEFLERFKSLL QKMIHQHLSSRTHGSEDS | 2.017 | 821 |
| IL-21_0504 | V53S, S99A | MRSSPGNMERIVICLMVIFLGTLVHKSSSQGQDRHM IRMRQLIDIVDQLKNYSNDLVPEFLPAPEDVETNCE WSAFSCFQKAQLKSANTGNNERIINVAIKKLKRKPP STNAGRRQKHRLTCPSCDSYEKKPPKEFLERFKSLL QKMIHQHLSSRTHGSEDS | 2.022 | 822 |
| IL-21_2695 | R114A, L120K | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNAGARQKHRKTCPSCDSYEKKPPKEFLERFKSLL QKMIHQHLSSRTHGSEDS | 2.025 | 823 |
| IL-21_4308 | D33A, D55E, K102Q, A112V | MRSSPGNMERIVICLMVIFLGTLVHKSSSQGQARHM IRMRQLIDIVDQLKNYVNELVPEFLPAPEDVETNCE WSAFSCFQKAQLKSANTGNNERIINVSIKQLKRKPP STNVGRRQKHRLTCPSCDSYEKKPPKEFLERFKSLL QKMIHQHLSSRTHGSEDS | 2.025 | 824 |
| IL-21_2767 | N111S, R114Y | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STSAGYRQKHRLTCPSCDSYEKKPPKEFLERFKSLL QKMIHQHLSSRTHGSEDS | 2.039 | 825 |
| IL-21_0548 | H35S, F60A | MRSSPGNMERIVICLMVIFLGTLVHKSSSQGQDRSM IRMRQLIDIVDQLKNYVNDLVPEALPAPEDVETNCE WSAFSCFQKAQLKSANTGNNERIINVSIKKLKRKPP STNAGRRQKHRLTCPSCDSYEKKPPKEFLERFKSLL QKMIHQHLSSRTHGSEDS | 2.04 | 826 |
| IL-21_2955 | Q116E, L120Q | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNAGRREKHRQTCPSCDSYEKKPPKEFLERFKSLL QKMIHQHLSSRTHGSEDS | 2.041 | 827 |
| IL-21_3687 | T89N, P107L, G113V | MRSSPGNMERIVICLMVIFLGTLVHKSSSQGQDRHM IRMRQLIDIVDQLKNYVNDLVPEFLPAPEDVETNCE WSAFSCFQKAQLKSANNGNNERIINVSIKKLKRKLP STNAVRRQKHRLTCPSCDSYEKKPPKEFLERFKSLL QKMIHQHLSSRTHGSEDS | 2.042 | 828 |
| IL-21_2829 | D33E, Q48E | MRSSPGNMERIVICLMVIFLGTLVHKSSSQGQERHM IRMRQLIDIVDELKNYVNDLVPEFLPAPEDVETNCE WSAFSCFQKAQLKSANTGNNERIINVSIKKLKRKPP STNAGRRQKHRLTCPSCDSYEKKPPKEFLERFKSLL QKMIHQHLSSRTHGSEDS | 2.043 | 829 |
| IL-21_1898 | I43Q, K50S, N54E, F60N, K106I | MRSSPGNMERIVICLMVIFLGTLVHKSSSQGQDRHM IRMRQLQDIVDQLSNYVEDLVPENLPAPEDVETNCE WSAFSCFQKAQLKSANTGNNERIINVSIKKLKRIPP STNAGRRQKHRLTCPSCDSYEKKPPKEFLERFKSLL QKMIHQHLSSRTHGSEDS | 2.048 | 830 |
| IL-21_2584 | I37E, R114E | MRSSPGNMERIVICLMVIFLGTLVHKSSSQGQDRHM ERMRQLIDIVDQLKNYVNDLVPEFLPAPEDVETNCE WSAFSCFQKAQLKSANTGNNERIINVSIKKLKRKPP STNAGERQKHRLTCPSCDSYEKKPPKEFLERFKSLL QKMIHQHLSSRTHGSEDS | 2.049 | 831 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_2951 | R34T, N111D | MRSSPGNMERIVICLMVIFLGTLVHKSSSQGQDTHM IRMRQLIDIVDQLKNYVNDLVPEFLPAPEDVETNCE WSAFSCFQKAQLKSANTGNNERIINVSIKKLKRKPP STDAGRRQKHRLTCPSCDSYEKKPPKEFLERFKSLL QKMIHQHLSSRTHGSEDS | 2.053 | 832 |
| IL-21_4063 | N91G, R114A, Q116T, T121P | MRSSPGNMERIVICLMVIFLGTLVHKSSSQGQDRHM IRMRQLIDIVDQLKNYVNDLVPEFLPAPEDVETNCE WSAFSCFQKAQLKSANTGGNERIINVSIKKLKRKPP STNAGARTKHRLPCPSCDSYEKKPPKEFLERFKSLL QKMIHQHLSSRTHGSEDS | 2.054 | 833 |
| IL-21_4728 | Q32S, W73Q, K104G, P107L, N111R | MRSSPGNMERIVICLMVIFLGTLVHKSSSQGSDRHM IRMRQLIDIVDQLKNYVNDLVPEFLPAPEDVETNCE QSAFSCFQKAQLKSANTGNNERIINVSIKKLGRKLP STRAGRRQKHRLTCPSCDSYEKKPPKEFLERFKSLL QKMIHQHLSSRTHGSEDS | 2.057 | 834 |
| IL-21_3655 | Q32I, M36N, R94N | MRSSPGNMERIVICLMVIFLGTLVHKSSSQGIDRHN IRMRQLIDIVDQLKNYVNDLVPEFLPAPEDVETNCE WSAFSCFQKAQLKSANTGNNENIINVSIKKLKRKPP STNAGRRQKHRLTCPSCDSYEKKPPKEFLERFKSLL QKMIHQHLSSRTHGSEDS | 2.06 | 835 |
| IL-21_2708 | H35F, M36P | MRSSPGNMERIVICLMVIFLGTLVHKSSSQGQDRFP IRMRQLIDIVDQLKNYVNDLVPEFLPAPEDVETNCE WSAFSCFQKAQLKSANTGNNERIINVSIKKLKRKPP STNAGRRQKHRLTCPSCDSYEKKPPKEFLERFKSLL QKMIHQHLSSRTHGSEDS | 2.062 | 836 |
| IL-21_0344 | N51H, R114S | MRSSPGNMERIVICLMVIFLGTLVHKSSSQGQDRHM IRMRQLIDIVDQLKHYVNDLVPEFLPAPEDVETNCE WSAFSCFQKAQLKSANTGNNERIINVSIKKLKRKPP STNAGSRQKHRLTCPSCDSYEKKPPKEFLERFKSLL QKMIHQHLSSRTHGSEDS | 2.066 | 837 |
| IL-21_3522 | Q32A, N111D, G113Q | MRSSPGNMERIVICLMVIFLGTLVHKSSSQGADRHM IRMRQLIDIVDQLKNYVNDLVPEFLPAPEDVETNCE WSAFSCFQKAQLKSANTGNNERIINVSIKKLKRKPP STDAQRRQKHRLTCPSCDSYEKKPPKEFLERFKSLL QKMIHQHLSSRTHGSEDS | 2.07 | 838 |
| IL-21_3095 | Q32A, R40H | MRSSPGNMERIVICLMVIFLGTLVHKSSSQGADRHM IRMHQLIDIVDQLKNYVNDLVPEFLPAPEDVETNCE WSAFSCFQKAQLKSANTGNNERIINVSIKKLKRKPP STNAGRRQKHRLTCPSCDSYEKKPPKEFLERFKSLL QKMIHQHLSSRTHGSEDS | 2.075 | 839 |
| IL-21_1229 | Q48L, N51T, V98N | MRSSPGNMERIVICLMVIFLGTLVHKSSSQGQDRHM IRMRQLIDIVDLLKTYVNDLVPEFLPAPEDVETNCE WSAFSCFQKAQLKSANTGNNERIINNSIKKLKRKPP STNAGRRQKHRLTCPSCDSYEKKPPKEFLERFKSLL QKMIHQHLSSRTHGSEDS | 2.078 | 840 |
| IL-21_0144 | K50S, V98I | MRSSPGNMERIVICLMVIFLGTLVHKSSSQGQDRHM IRMRQLIDIVDQLSNYVNDLVPEFLPAPEDVETNCE WSAFSCFQKAQLKSANTGNNERIINISIKKLKRKPP STNAGRRQKHRLTCPSCDSYEKKPPKEFLERFKSLL QKMIHQHLSSRTHGSEDS | 2.079 | 841 |
| IL-21_0539 | N51T, N111S | MRSSPGNMERIVICLMVIFLGTLVHKSSSQGQDRHM IRMRQLIDIVDQLKTYVNDLVPEFLPAPEDVETNCE WSAFSCFQKAQLKSANTGNNERIINVSIKKLKRKPP STSAGRRQKHRLTCPSCDSYEKKPPKEFLERFKSLL QKMIHQHLSSRTHGSEDS | 2.08 | 842 |
| IL-21_2928 | D33E, K104S | MRSSPGNMERIVICLMVIFLGTLVHKSSSQGQERHM IRMRQLIDIVDQLKNYVNDLVPEFLPAPEDVETNCE WSAFSCFQKAQLKSANTGNNERIINVSIKKLSRKPP STNAGRRQKHRLTCPSCDSYEKKPPKEFLERFKSLL QKMIHQHLSSRTHGSEDS | 2.082 | 843 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_2138 | R38H, I45T, P62A, N111Y, R114Y | MRSSPGNMERIVICLMVIFLGTLVHKSSSQGQDRHMIHMRQLIDTVDQLKNYVNDLVPEFLAAPEDVETNCEWSAFSCFQKAQLKSANTGNNERIINVSIKKLKRKPPSTYAGYRQKHRLTCPSCDSYEKKPPKEFLERFKSLLQKMIHQHLSSRTHGSEDS | 2.082 | 844 |
| IL-21_4261 | Q32E, H35T, I37M, N70T | MRSSPGNMERIVICLMVIFLGTLVHKSSSQGEDRTMMRMRQLIDIVDQLKNYVNDLVPEFLPAPEDVETTCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 2.087 | 845 |
| IL-21_2371 | H35E, N51T, E59L, K106Q, G113A | MRSSPGNMERIVICLMVIFLGTLVHKSSSQGQDREMIRMRQLIDIVDQLKTYVNDLVPLFLPAPEDVETNCEWSAFSCFQKAQLKSANTGNNERIINVSIKKLKRQPPSTNAARRQKHRLTCPSCDSYEKKPPKEFLERFKSLLQKMIHQHLSSRTHGSEDS | 2.089 | 846 |
| IL-21_2840 | P62H, S99L | MRSSPGNMERIVICLMVIFLGTLVHKSSSQGQDRHMIRMRQLIDIVDQLKNYVNDLVPEFLHAPEDVETNCEWSAFSCFQKAQLKSANTGNNERIINVLIKKLKRKPPSTNAGRRQKHRLTCPSCDSYEKKPPKEFLERFKSLLQKMIHQHLSSRTHGSEDS | 2.09 | 847 |
| IL-21_2714 | F60L, N111S | MRSSPGNMERIVICLMVIFLGTLVHKSSSQGQDRHMIRMRQLIDIVDQLKNYVNDLVPELLPAPEDVETNCEWSAFSCFQKAQLKSANTGNNERIINVSIKKLKRKPPSTSAGRRQKHRLTCPSCDSYEKKPPKEFLERFKSLLQKMIHQHLSSRTHGSEDS | 2.091 | 848 |
| IL-21_0188 | H35Y, I43S | MRSSPGNMERIVICLMVIFLGTLVHKSSSQGQDRYMIRMRQLSDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 2.093 | 849 |
| IL-21_3695 | N70H, R115Q, L120A | MRSSPGNMERIVICLMVIFLGTLVHKSSSQGQDRHMIRMRQLIDIVDQLKNYVNDLVPEFLPAPEDVETHCEWSAFSCFQKAQLKSANTGNNERIINVSIKKLKRKPPSTNAGRQQKHRATCPSCDSYEKKPPKEFLERFKSLLQKMIHQHLSSRTHGSEDS | 2.094 | 850 |
| IL-21_4713 | N92S, K106L, N111T, H118Q, I148L | MRSSPGNMERIVICLMVIFLGTLVHKSSSQGQDRHMIRMRQLIDIVDQLKNYVNDLVPEFLPAPEDVETNCEWSAFSCFQKAQLKSANTGNSERIINVSIKKLKRLPPSTTAGRRQKQRLTCPSCDSYEKKPPKEFLERFKSLLQKMLHQHLSSRTHGSEDS | 2.094 | 851 |
| IL-21_2858 | T69D, R115K | MRSSPGNMERIVICLMVIFLGTLVHKSSSQGQDRHMIRMRQLIDIVDQLKNYVNDLVPEFLPAPEDVEDNCEWSAFSCFQKAQLKSANTGNNERIINVSIKKLKRKPPSTNAGRKQKHRLTCPSCDSYEKKPPKEFLERFKSLLQKMIHQHLSSRTHGSEDS | 2.098 | 852 |
| IL-21_4227 | H35S, V57K, E65N, N91E | MRSSPGNMERIVICLMVIFLGTLVHKSSSQGQDRSMIRMRQLIDIVDQLKNYVNDLKPEFLPAPNDVETNCEWSAFSCFQKAQLKSANTGENERIINVSIKKLKRKPPSTNAGRRQKHRLTCPSCDSYEKKPPKEFLERFKSLLQKMIHQHLSSRTHGSEDS | 2.099 | 853 |
| IL-21_1061 | N51H, E65Q, P107M | MRSSPGNMERIVICLMVIFLGTLVHKSSSQGQDRHMIRMRQLIDIVDQLKHYVNDLVPEFLPAPQDVETNCEWSAFSCFQKAQLKSANTGNNERIINVSIKKLKRKMPSTNAGRRQKHRLTCPSCDSYEKKPPKEFLERFKSLLQKMIHQHLSSRTHGSEDS | 2.099 | 854 |
| IL-21_4057 | N91K, H118E, L120D, E138K | MRSSPGNMERIVICLMVIFLGTLVHKSSSQGQDRHMIRMRQLIDIVDQLKNYVNDLVPEFLPAPEDVETNCEWSAFSCFQKAQLKSANTGKNERIINVSIKKLKRKPPSTNAGRRQKERDTCPSCDSYEKKPPKEFLKRFKSLLQKMIHQHLSSRTHGSEDS | 2.102 | 855 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_3460 | E72L, T89S, P107I | MRSSPGNMERIVICLMVIFLGTLVHKSSSQGQDRHM IRMRQLIDIVDQLKNYVNDLVPEFLPAPEDVETNCL WSAFSCFQKAQLKSANSGNNERIINVSIKKLKRKIP STNAGRRQKHRLTCPSCDSYEKKPPKEFLERFKSLL QKMIHQHLSSRTHGSEDS | 2.106 | 856 |
| IL-21_4064 | D33P, M36I, S86A, R114V | MRSSPGNMERIVICLMVIFLGTLVHKSSSQGQPRHI IRMRQLIDIVDQLKNYVNDLVPEFLPAPEDVETNCE WSAFSCFQKAQLKAANTGNNERIINVSIKKLKRKPP STNAGVRQKHRLTCPSCDSYEKKPPKEFLERFKSLL QKMIHQHLSSRTHGSEDS | 2.107 | 857 |
| IL-21_1338 | K50G, V57S, F60D, A112T | MRSSPGNMERIVICLMVIFLGTLVHKSSSQGQDRHM IRMRQLIDIVDQLGNYVNDLSPEDLPAPEDVETNCE WSAFSCFQKAQLKSANTGNNERIINVSIKKLKRKPP STNTGRRQKHRLTCPSCDSYEKKPPKEFLERFKSLL QKMIHQHLSSRTHGSEDS | 2.107 | 858 |
| IL-21_3037 | H118E, T121P | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINVSIKKLKRKPP STNAGRRQKERLPCPSCDSYEKKPPKEFLERFKSLL QKMIHQHLSSRTHGSEDS | 2.111 | 859 |
| IL-21_2907 | Q83E, T121K | MRSSPGNMERIVICLMVIFLGTLVHKSSSQGQDRHM IRMRQLIDIVDQLKNYVNDLVPEFLPAPEDVETNCE WSAFSCFQKAELKSANTGNNERIINVSIKKLKRKPP STNAGRRQKHRLKCPSCDSYEKKPPKEFLERFKSLL QKMIHQHLSSRTHGSEDS | 2.118 | 860 |
| IL-21_4796 | D33W, I43V, F76L, V98S, R114T | MRSSPGNMERIVICLMVIFLGTLVHKSSSQGQWRHM IRMRQLVDIVDQLKNYVNDLVPEFLPAPEDVETNCE WSALSCFQKAQLKSANTGNNERIINSSIKKLKRKPP STNAGTRQKHRLTCPSCDSYEKKPPKEFLERFKSLL QKMIHQHLSSRTHGSEDS | 2.119 | 861 |
| IL-21_0775 | D44S, P107I, R115T | MRSSPGNMERIVICLMVIFLGTLVHKSSSQGQDRHM IRMRQLISIVDQLKNYVNDLVPEFLPAPEDVETNCE WSAFSCFQKAQLKSANTGNNERIINVSIKKLKRKIP STNAGRTQKHRLTCPSCDSYEKKPPKEFLERFKSLL QKMIHQHLSSRTHGSEDS | 2.119 | 862 |
| IL-21_3699 | H35S, P58V, K106V | MRSSPGNMERIVICLMVIFLGTLVHKSSSQGQDRSM IRMRQLIDIVDQLKNYVNDLVVEFLPAPEDVETNCE WSAFSCFQKAQLKSANTGNNERIINVSIKKLKRVPP STNAGRRQKHRLTCPSCDSYEKKPPKEFLERFKSLL QKMIHQHLSSRTHGSEDS | 2.125 | 863 |
| IL-21_2690 | H35M, R114A | MRSSPGNMERIVICLMVIFLGTLVHKSSSQGQDRMM IRMRQLIDIVDQLKNYVNDLVPEFLPAPEDVETNCE WSAFSCFQKAQLKSANTGNNERIINVSIKKLKRKPP STNAGARQKHRLTCPSCDSYEKKPPKEFLERFKSLL QKMIHQHLSSRTHGSEDS | 2.132 | 864 |
| IL-21_0570 | K50S, S77Y | MRSSPGNMERIVICLMVIFLGTLVHKSSSQGQDRHM IRMRQLIDIVDQLSNYVNDLVPEFLPAPEDVETNCE WSAFYCFQKAQLKSANTGNNERIINVSIKKLKRKPP STNAGRRQKHRLTCPSCDSYEKKPPKEFLERFKSLL QKMIHQHLSSRTHGSEDS | 2.14 | 865 |
| IL-21_2854 | V98I, R119K | MRSSPGNMERIVICLMVIFLGTLVHKSSSQGQDRHM IRMRQLIDIVDQLKNYVNDLVPEFLPAPEDVETNCE WSAFSCFQKAQLKSANTGNNERIINISIKKLKRKPP STNAGRRQKHKLTCPSCDSYEKKPPKEFLERFKSLL QKMIHQHLSSRTHGSEDS | 2.143 | 866 |
| IL-21_2733 | T69R, R94T | MRSSPGNMERIVICLMVIFLGTLVHKSSSQGQDRHM IRMRQLIDIVDQLKNYVNDLVPEFLPAPEDVERNCE WSAFSCFQKAQLKSANTGNNETIINVSIKKLKRKPP STNAGRRQKHRLTCPSCDSYEKKPPKEFLERFKSLL QKMIHQHLSSRTHGSEDS | 2.144 | 867 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_3393 | D33E, G113M, R115A | MRSSPGNMERIVICLMVIFLGTLVHKSSSQGQERHM IRMRQLIDIVDQLKNYVNDLVPEFLPAPEDVETNCE WSAFSCFQKAQLKSANTGNNERIINVSIKKLKRKPP STNAMRAQKHRLTCPSCDSYEKKPPKEFLERFKSLL QKMIHQHLSSRTHGSEDS | 2.146 | 868 |
| IL-21_3334 | M36T, P107I, G113N | MRSSPGNMERIVICLMVIFLGTLVHKSSSQGQDRHT IRMRQLIDIVDQLKNYVNDLVPEFLPAPEDVETNCE WSAFSCFQKAQLKSANTGNNERIINVSIKKLKRKIP STNANRRQKHRLTCPSCDSYEKKPPKEFLERFKSLL QKMIHQHLSSRTHGSEDS | 2.15 | 869 |
| IL-21_0467 | K50G, V98I | MRSSPGNMERIVICLMVIFLGTLVHKSSSQGQDRHM IRMRQLIDIVDQLGNYVNDLVPEFLPAPEDVETNCE WSAFSCFQKAQLKSANTGNNERIINISIKKLKRKPP STNAGRRQKHRLTCPSCDSYEKKPPKEFLERFKSLL QKMIHQHLSSRTHGSEDS | 2.153 | 870 |
| IL-21_2920 | N70G, W73L | MRSSPGNMERIVICLMVIFLGTLVHKSSSQGQDRHM IRMRQLIDIVDQLKNYVNDLVPEFLPAPEDVETGCE LSAFSCFQKAQLKSANTGNNERIINVSIKKLKRKPP STNAGRRQKHRLTCPSCDSYEKKPPKEFLERFKSLL QKMIHQHLSSRTHGSEDS | 2.157 | 871 |
| IL-21_4139 | N54K, S77V, V98Q, R114A | MRSSPGNMERIVICLMVIFLGTLVHKSSSQGQDRHM IRMRQLIDIVDQLKNYVKDLVPEFLPAPEDVETNCE WSAFVCFQKAQLKSANTGNNERIINQSIKKLKRKPP STNAGARQKHRLTCPSCDSYEKKPPKEFLERFKSLL QKMIHQHLSSRTHGSEDS | 2.157 | 872 |
| IL-21_0405 | I45T, K81S | MRSSPGNMERIVICLMVIFLGTLVHKSSSQGQDRHM IRMRQLIDTVDQLKNYVNDLVPEFLPAPEDVETNCE WSAFSCFQSAQLKSANTGNNERIINVSIKKLKRKPP STNAGRRQKHRLTCPSCDSYEKKPPKEFLERFKSLL QKMIHQHLSSRTHGSEDS | 2.159 | 873 |
| IL-21_0345 | N51H, L61Y | MRSSPGNMERIVICLMVIFLGTLVHKSSSQGQDRHM IRMRQLIDIVDQLKHYVNDLVPEFYPAPEDVETNCE WSAFSCFQKAQLKSANTGNNERIINVSIKKLKRKPP STNAGRRQKHRLTCPSCDSYEKKPPKEFLERFKSLL QKMIHQHLSSRTHGSEDS | 2.162 | 874 |
| IL-21_0772 | R40L, D44S, K102E | MRSSPGNMERIVICLMVIFLGTLVHKSSSQGQDRHM IRMLQLISIVDQLKNYVNDLVPEFLPAPEDVETNCE WSAFSCFQKAQLKSANTGNNERIINVSIKELKRKPP STNAGRRQKHRLTCPSCDSYEKKPPKEFLERFKSLL QKMIHQHLSSRTHGSEDS | 2.163 | 875 |
| IL-21_0604 | Y52H, K104E | MRSSPGNMERIVICLMVIFLGTLVHKSSSQGQDRHM IRMRQLIDIVDQLKNHVNDLVPEFLPAPEDVETNCE WSAFSCFQKAQLKSANTGNNERIINVSIKKLERKPP STNAGRRQKHRLTCPSCDSYEKKPPKEFLERFKSLL QKMIHQHLSSRTHGSEDS | 2.165 | 876 |
| IL-21_2781 | H35T, T69G | MRSSPGNMERIVICLMVIFLGTLVHKSSSQGQDRTM IRMRQLIDIVDQLKNYVNDLVPEFLPAPEDVEGNCE WSAFSCFQKAQLKSANTGNNERIINVSIKKLKRKPP STNAGRRQKHRLTCPSCDSYEKKPPKEFLERFKSLL QKMIHQHLSSRTHGSEDS | 2.173 | 877 |
| IL-21_4134 | H35F, M36T, V98Q, A112R | MRSSPGNMERIVICLMVIFLGTLVHKSSSQGQDRFT IRMRQLIDIVDQLKNYVNDLVPEFLPAPEDVETNCE WSAFSCFQKAQLKSANTGNNERIINQSIKKLKRKPP STNRGRRQKHRLTCPSCDSYEKKPPKEFLERFKSLL QKMIHQHLSSRTHGSEDS | 2.178 | 878 |
| IL-21_3621 | R34G, H35T, R115H | MRSSPGNMERIVICLMVIFLGTLVHKSSSQGQDGTM IRMRQLIDIVDQLKNYVNDLVPEFLPAPEDVETNCE WSAFSCFQKAQLKSANTGNNERIINVSIKKLKRKPP STNAGRHQKHRLTCPSCDSYEKKPPKEFLERFKSLL QKMIHQHLSSRTHGSEDS | 2.179 | 879 |

TABLE 9-continued

Protein Expression Yields and Purity for Stabilized IL-21-Fc Fusion Proteins

| Variant Name | Mutations | Amino Acid Sequence | Predicted Affinity | SEQ ID NO |
|---|---|---|---|---|
| IL-21_3033 | N70G, S77A | MRSSPGNMERIVICLMVIFLGTLVHKSSSQGQDRHMIRMRQLIDIVDQLKNYVNDLVPEFLPAPEDVETGCEWSAFACFQKAQLKSANTGNNERIINVSIKKLKRKPPSTNAGRRQKHRLTCPSCDSYEKKPPKEFLERFKSLLQKMIHQHLSSRTHGSEDS | 2.18 | 880 |
| IL-21_4747 | M36A, V57A, E59T, F60L, V98L | MRSSPGNMERIVICLMVIFLGTLVHKSSSQGQDRHAIRMRQLIDIVDQLKNYVNDLAPTLLPAPEDVETNCEWSAFSCFQKAQLKSANTGNNERIINLSIKKLKRKPPSTNAGRRQKHRLTCPSCDSYEKKPPKEFLERFKSLLQKMIHQHLSSRTHGSEDS | 2.182 | 881 |
| IL-21_2941 | N97T, R114V | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIITVSIKKLKRKPPSTNAGVRQKHRLTCPSCDSYEKKPPKEFLERFKSLLQKMIHQHLSSRTHGSEDS | 2.185 | 882 |
| IL-21_2693 | H35S, M36T | MRSSPGNMERIVICLMVIFLGTLVHKSSSQGQDRSTIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 2.188 | 883 |

TABLE 10

IL-21 Combination Mutant Stabilized Variants

| Variant Name | Mutations | Amino Acid Sequence | Predicted Affinity | SEQ ID NO |
|---|---|---|---|---|
| IL-21_5995 | H35F, K81D, R114G, R115D | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSTNAGGDQKHRLTCPSCDSYEKKPPKEFLERFKSLLQKMIHQHLSSRTHGSEDS | 0.421 | 884 |
| IL-21_6003 | H35F, K81D, T110D, R115D | MRSSPGNMERIVICLMVIFLGTLVHKSSSQGQDREMIRMRQLIDIVDQLKNYVNDLVPEFLPAPEDVETNCEWSAFSCFQDAQLKSANTGNNERIINVSIKKLKRKPPSDNAGRDQKHRLTCPSCDSYEKKPPKEFLERFKSLLQKMIHQHLSSRTHGSEDS | 0.445 | 885 |
| IL-21_5503 | N70G, K81D, V98E, R115D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINESIKKLKRKPPSTNAGRDQKHRLTCPSCDSYEKKPPKEFLERFKSLLQKMIHQHLSSRTHGSEDS | 0.464 | 886 |
| IL-21_5303 | K81D, V98E, P107V, R115G | MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKVPSTNAGRGQKHRLTCPSCDSYEKKPPKEFLERFKSLLQKMIHQHLSSRTHGSEDS | 0.493 | 887 |
| IL-21_5502 | N70G, K81D, V98E, R115G | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINESIKKLKRKPPSTNAGRGQKHRLTCPSCDSYEKKPPKEFLERFKSLLQKMIHQHLSSRTHGSEDS | 0.502 | 888 |
| IL-21_5263 | K81D, P107V, T110D, R114G | MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSDNAGGRQKHRLTCPSCDSYEKKPPKEFLERFKSLLQKMIHQHLSSRTHGSEDS | 0.513 | 889 |
| IL-21_6013 | H35F, K81D, V98E, R115G | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKRKPPSTNAGRGQKHRLTCPSCDSYEKKPPKEFLERFKSLLQKMIHQHLSSRTHGSEDS | 0.516 | 890 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5271 | K81D, V98E, R115G, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGRGQKDRLTCP SCDSYEKKPPKEFLERFKSLLQKMIHQHLSSRTHGSEDS | 0.518 | 891 |
| IL-21_5272 | K81D, V98E, R115D, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGRDQKHRLECP SCDSYEKKPPKEFLERFKSLLQKMIHQHLSSRTHGSEDS | 0.519 | 892 |
| IL-21_5304 | K81D, V98E, P107V, R115D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKVPSTNAGRDQKHRLTCP SCDSYEKKPPKEFLERFKSLLQKMIHQHLSSRTHGSEDS | 0.521 | 893 |
| IL-21_6018 | H35F, K81D, V98E, T110D | MRSSPGNMERIVICLMVIFLGTLVHKSSSQGQDREMIRMRQ LIDIVDQLKNYVNDLVPEFLPAPEDVETNCEWSAFSCFQDA QLKSANTGNNERIINESIKKLKRKPPSDNAGRRQKHRLTCP SCDSYEKKPPKEFLERFKSLLQKMIHQHLSSRTHGSEDS | 0.533 | 894 |
| IL-21_5305 | K81D, V98E, 1P07V, R114G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKVPSTNAGGRQKHRLTCP SCDSYEKKPPKEFLERFKSLLQKMIHQHLSSRTHGSEDS | 0.534 | 895 |
| IL-21_5976 | H35F, V98E, R114G, R115D | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINESIKKLKRKPPSTNAGGDQKHRLTCP SCDSYEKKPPKEFLERFKSLLQKMIHQHLSSRTHGSEDS | 0.542 | 896 |
| IL-21_6016 | H35F, K81D, V98E, R114Q | MRSSPGNMERIVICLMVIFLGTLVHKSSSQGQDREMIRMRQ LIDIVDQLKNYVNDLVPEFLPAPEDVETNCEWSAFSCFQDA QLKSANTGNNERIINESIKKLKRKPPSTNAGORQKHRLTCP SCDSYEKKPPKEFLERFKSLLQKMIHQHLSSRTHGSEDS | 0.543 | 897 |
| IL-21_5072 | V98E, R114G, R115D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGGDQKHTLTCP SCDSYEKKPPKEFLERFKSLLOKMIHQHLSSRTHGSEDS | 0.545 | 898 |
| IL-21_5107 | V98E, T110D, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGRGQKDRLTCP SCDSYEKKPPKEFLERFKSLLQKMIHQHLSSRTHGSEDS | 0.547 | 899 |
| IL-21_5508 | N70G, K81D, V98E, P107V | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINESIKKLKRKVPSTNAGRRQKHRLTCP SCDSYEKKPPKEFLERFKSLLQKMIHQHLSSRTHGSEDS | 0.552 | 900 |
| IL-21_5283 | K81D, V98E, R114Q, R115G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGQGQKHRLTCP SCDSYEKKPPKEFLERFKSLLQKMIHQHLSSRTHGSEDS | 0.554 | 901 |
| IL-21_5308 | K81D, V98E, P107V, T110D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKVPSDNAGRRQKHRLTCP SCDSYEKKPPKEFLERFKSLLQKMIHQHLSSRTHGSEDS | 0.561 | 902 |
| IL-21_5296 | K81D, V98E, T110D, R115D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSDNAGRDQKHRLTCP SCDSYEKKPPKEFLERFKSLLQKMIHQHLSSRTHGSEDS | 0.562 | 903 |
| IL-21_5267 | K81D, V98E, H118D, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGRROKDRLECP SCDSYEKKPPKEFLERFKSLLQKMIHQHLSSRTHGSEDS | 0.566 | 904 |
| IL-21_5120 | V98E, T110D, R114Q, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGQDQKHRLTCP SCDSYEKKPPKEFLERFKSLLQKMIHQHLSSRTHGSEDS | 0.571 | 905 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_6004 | H35F, K81D, T110D, R114G | MRSSPGNMERIVICLMVIFLGTLVHKSSSQGQDREMIRMRQ<br>LIDIVDQLKNYVNDLVPEFLPAPEDVETNCEWSAFSCFQDA<br>QLKSANTGNNERIINVSIKKLKRKPPSDNAGGRQKHRLTCP<br>SCDSYEKKPPKEFLERFKSLLQKMIHQHLSSRTHGSEDS | 0.573 | 906 |
| IL-21_5302 | K81D, V98E, P107V, H118D | MRSSPGNMERIVICLMVIFLGTLVHKSSSQGQDRHMIRMRQ<br>LIDIVDQLKNYVNDLVPEFLPAPEDVETNCEWSAFSCFQDA<br>QLKSANTGNNERIINESIKKLKRKVPSTNAGRRQKDRLTCP<br>SCDSYEKKPPKEFLERFKSLLQKMIHQHLSSRTHGSEDS | 0.576 | 907 |
| IL-21_5290 | K81D, V98E, A112P, R114G | MRSSPGNMERIVICLMVIFLGTLVHKSSSQGQDRHMIRMRQ<br>LIDIVDQLKNYVNDLVPEFLPAPEDVETNCEWSAFSCFQDA<br>QLKSANTGNNERIINESIKKLKRKPPSTNPGGRQKHRLTCP<br>SCDSYEKKPPKEFLERFKSLLQKMIHQHLSSRTHGSEDS | 0.579 | 908 |
| IL-21_5239 | K81D, P107V, R115D, R119T | MRSSPGNMERIVICLMVIFLGTLVHKSSSQGQDRHMIRMRQ<br>LIDIVDQLKNYVNDLVPEFLPAPEDVETNCEWSAFSCFQDA<br>QLKSANTGNNERIINVSIKKLKRKVPSTNAGRDQKHTLTCP<br>SCDSYEKKPPKEFLERFKSLLQKMIHQHLSSRTHGSEDS | 0.581 | 909 |
| IL-21_5668 | K81D, R114G, R115D | MRSSPGNMERIVICLMVIFLGTLVHKSSSQGQDRHMIRMRQ<br>LIDIVDQLKNYVNDLVPEFLPAPEDVETNCEWSAFSCFQDA<br>QLKSANTGNNERIINVSIKKLKRKPPSTNAGGDQKHRLTCP<br>SCDSYEKKPPKEFLERFKSLLQKMIHQHLSSRTHGSEDS | 0.583 | 910 |
| IL-21_5082 | V98E, R114Q, R115D, H118D | MRSSPGNMERIVICLMVIFLGTLVHKSSSQGQDRHMIRMRQ<br>LIDIVDQLKNYVNDLVPEFLPAPEDVETNCEWSAFSCFQKA<br>QLKSANTGNNERIINESIKKLKRKPPSTNAGQDQKDRLTCP<br>SCDSYEKKPPKEFLERFKSLLQKMIHQHLSSRTHGSEDS | 0.584 | 911 |
| IL-21_5146 | V98E, P107V, R114Q, R115D | MRSSPGNMERIVICLMVIFLGTLVHKSSSQGQDRHMIRMRQ<br>LIDIVDQLKNYVNDLVPEFLPAPEDVETNCEWSAFSCFQKA<br>QLKSANTGNNERIINESIKKLKRKVPSTNAGQDQKHRLTCP<br>SCDSYEKKPPKEFLERFKSLLQKMIHQHLSSRTHGSEDS | 0.586 | 912 |
| IL-21_5073 | V98E, R114G, R115D, H118D | MRSSPGNMERIVICLMVIFLGTLVHKSSSQGQDRHMIRMRQ<br>LIDIVDQLKNYVNDLVPEFLPAPEDVETNCEWSAFSCFQKA<br>QLKSANTGNNERIINESIKKLKRKPPSTNAGGDQKDRLTCP<br>SCDSYEKKPPKEFLERFKSLLQKMIHQHLSSRTHGSEDS | 0.591 | 913 |
| IL-21_6165 | H35I, K81D, V98E, T110D | MRSSPGNMERIVICLMVIFLGTLVHKSSSQGQDRIMIRMRQ<br>LIDIVDQLKNYVNDLVPEFLPAPEDVETNCEWSAFSCFQDA<br>QLKSANTGNNERIINESIKKLKRKPPSDNAGRRQKHRLTCP<br>SCDSYEKKPPKEFLERFKSLLQKMIHQHLSSRTHGSEDS | 0.595 | 914 |
| IL-21_5443 | N70G, V98E, T110D, R115D | MRSSPGNMERIVICLMVIFLGTLVHKSSSQGQDRHMIRMRQ<br>LIDIVDQLKNYVNDLVPEFLPAPEDVETGCEWSAFSCFQKA<br>QLKSANTGNNERIINESIKKLKRKPPSDNAGRDQKHRLTCP<br>SCDSYEKKPPKEFLERFKSLLQKMIHQHLSSRTHGSEDS | 0.595 | 915 |
| IL-21_5306 | K81D, V98E, P107V, R114Q | MRSSPGNMERIVICLMVIFLGTLVHKSSSQGQDRHMIRMRQ<br>LIDIVDQLKNYVNDLVPEFLPAPEDVETNCEWSAFSCFQDA<br>QLKSANTGNNERIINESIKKLKRKVPSTNAGORQKHRLTCP<br>SCDSYEKKPPKEFLERFKSLLQKMIHQHLSSRTHGSEDS | 0.6 | 916 |
| IL-21_6125 | H35I, V98E, R114Q, R115D | MRSSPGNMERIVICLMVIFLGTLVHKSSSQGQDRIMIRMRQ<br>LIDIVDQLKNYVNDLVPEFLPAPEDVETNCEWSAFSCFQKA<br>QLKSANTGNNERIINESIKKLKRKPPSTNAGQDQKHRLTCP<br>SCDSYEKKPPKEFLERFKSLLQKMIHQHLSSRTHGSEDS | 0.603 | 917 |
| IL-21_6186 | H35I, N70G, V98E, R115D | MRSSPGNMERIVICLMVIFLGTLVHKSSSQGQDRIMIRMRQ<br>LIDIVDQLKNYVNDLVPEFLPAPEDVETGCEWSAFSCFQKA<br>QLKSANTGNNERIINESIKKLKRKPPSTNAGRDQKHRLTCP<br>SCDSYEKKPPKEFLERFKSLLQKMIHQHLSSRTHGSEDS | 0.606 | 918 |
| IL-21_6017 | H35F, K81D, V98E, A112P | MRSSPGNMERIVICLMVIFLGTLVHKSSSQGQDREMIRMRQ<br>LIDIVDQLKNYVNDLVPEFLPAPEDVETNCEWSAFSCFQDA<br>QLKSANTGNNERIINESIKKLKRKPPSTNPGRRQKHRLTCP<br>SCDSYEKKPPKEFLERFKSLLQKMIHQHLSSRTHGSEDS | 0.606 | 919 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5250 | K81D, P107V, R114Q, R115D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGQDQKHRLTCP SCDSYEKKPPKEFLERFKSLLQKMIHQHLSSRTHGSEDS | 0.609 | 920 |
| IL-21_6166 | H35I, K81D, V98E, P107V | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINESIKKLKRKVPSTNAGRRQKHRLTCP SCDSYEKKPPKEFLERFKSLLQKMIHQHLSSRTHGSEDS | 0.611 | 921 |
| IL-21_5224 | K81D, T110D, R114Q, R115D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGQDQKHRLTCP SCDSYEKKPPKEFLERFKSLLQKMIHQHLSSRTHGSEDS | 0.611 | 922 |
| IL-21_5702 | K81D, V98E, R115D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGRDQKHRLTCP SCDSYEKKPPKEFLERFKSLLQKMIHQHLSSRTHGSEDS | 0.611 | 923 |
| IL-21_5625 | V98E, R114G, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGGDQKHRLTCP SCDSYEKKPPKEFLERFKSLLQKMIHQHLSSRTHGSEDS | 0.611 | 924 |
| IL-21_5706 | K81D, V98E, T110D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSDNAGRROKHRLTCP SCDSYEKKPPKEFLERFKSLLOKMIHQHLSSRTHGSEDS | 0.613 | 925 |
| IL-21_6161 | H35I, K81D, V98E, R115D | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINESIKKLKRKPPSTNAGRDQKHRLTCP SCDSYEKKPPKEFLERFKSLLQKMIHQHLSSRTHGSEDS | 0.613 | 926 |
| IL-21_5110 | V98E, T110D, R115D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGRDQKDRLTCP SCDSYEKKPPKEFLERFKSLLQKMIHQHLSSRTHGSEDS | 0.614 | 927 |
| IL-21_5249 | K81D, P107V, R114Q, R115G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGQGQKHRLTCP SCDSYEKKPPKEFLERFKSLLQKMIHQHLSSRTHGSEDS | 0.617 | 928 |
| IL-21_5167 | K81D, R115D, H118D, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRDQKDRLECP SCDSYEKKPPKEFLERFKSLLQKMIHQHLSSRTHGSEDS | 0.617 | 929 |
| IL-21_5997 | H35F, K81D, R114Q, R115D | MRSSPGNMERIVICLMVIFLGTLVHKSSSQGQDREMIRMRQ LIDIVDQLKNYVNDLVPEFLPAPEDVETNCEWSAFSCFQDA QLKSANTGNNERIINVSIKKLKRKPPSTNAGQDQKHRLTCP SCDSYEKKPPKEFLERFKSLLQKMIHQHLSSRTHGSEDS | 0.619 | 930 |
| IL-21_6014 | H35F, K81D, V98E, R115D | MRSSPGNMERIVICLMVIFLGTLVHKSSSQGQDREMIRMRQ LIDIVDQLKNYVNDLVPEFLPAPEDVETNCEWSAFSCFQDA QLKSANTGNNERIINESIKKLKRKPPSTNAGRDQKHRLTCP SCDSYEKKPPKEFLERFKSLLQKMIHQHLSSRTHGSEDS | 0.62 | 931 |
| IL-21_5431 | N70G, V98E, R114Q, R115D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGQDQKHRLTCP SCDSYEKKPPKEFLERFKSLLQKMIHQHLSSRTHGSEDS | 0.621 | 932 |
| IL-21_5707 | K81D, V98E, P107V | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKVPSTNAGRRQKHRLTCP SCDSYEKKPPKEFLERFKSLLQKMIHQHLSSRTHGSEDS | 0.622 | 933 |
| IL-21_5978 | H35F, V98E, R114Q, R115D | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINESIKKLKRKPPSTNAGQDQKHRLTCP SCDSYEKKPPKEFLERFKSLLQKMIHQHLSSRTHGSEDS | 0.623 | 934 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_6163 | H35I, K81D, V98E, R114Q | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINESIKKLKRKPPSTNAGQRQKHRLTCP SCDSYEKKPPKEFLERFKSLLOKMIHQHLSSRTHGSEDS | 0.624 | 935 |
| IL-21_5079 | V98E, R114Q, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGQGQKDRLTCP SCDSYEKKPPKEFLERFKSLLQKMIHQHLSSRTHGSEDS | 0.626 | 936 |
| IL-21_5113 | V98E, T110D, R114G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGGRQKDRLTCP SCDSYEKKPPKEFLERFKSLLQKMIHQHLSSRTHGSEDS | 0.627 | 937 |
| IL-21_5299 | K81D, V98E, T110D, A112P | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSDNPGRRQKHRLTCP SCDSYEKKPPKEFLERFKSLLQKMIHQHLSSRTHGSEDS | 0.628 | 938 |
| IL-21_5307 | K81D, V98E, P107V, A112P | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKVPSTNPGRROKHRLTCP SCDSYEKKPPKEFLERFKSLLQKMIHQHLSSRTHGSEDS | 0.631 | 939 |
| IL-21_5104 | V98E, T110D, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGRROKDTLTCP SCDSYEKKPPKEFLERFKSLLQKMIHQHLSSRTHGSEDS | 0.632 | 940 |
| IL-21_5279 | K81D, V98E, R114G, R115D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGGDQKHRLTCP SCDSYEKKPPKEFLERFKSLLQKMIHQHLSSRTHGSEDS | 0.634 | 941 |
| IL-21_5064 | V98E, R115D, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRDQKDTLTCP SCDSYEKKPPKEFLERFKSLLQKMIHQHLSSRTHGSEDS | 0.634 | 942 |
| IL-21_5115 | V98E, T110D, R114G, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGGDQKHRLTCP SCDSYEKKPPKEFLERFKSLLQKMIHQHLSSRTHGSEDS | 0.635 | 943 |
| IL-21_5642 | V98E, T110D, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGRDQKHRLTCP SCDSYEKKPPKEFLERFKSLLQKMIHQHLSSRTHGSEDS | 0.635 | 944 |
| IL-21_6015 | H35F, K81D, V98E, R114G | MRSSPGNMERIVICLMVIFLGTLVHKSSSQGQDREMIRMRQ LIDIVDQLKNYVNDLVPEFLPAPEDVETNCEWSAFSCFQDA QLKSANTGNNERIINESIKKLKRKPPSTNAGGROKHRLTCP SCDSYEKKPPKEFLERFKSLLQKMIHQHLSSRTHGSEDS | 0.637 | 945 |
| IL-21_5421 | N70G, V98E, R115D, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGRDQKDRLTCP SCDSYEKKPPKEFLERFKSLLQKMIHQHLSSRTHGSEDS | 0.638 | 946 |
| IL-21_6008 | H35F, K81D, P107V, R115D | MRSSPGNMERIVICLMVIFLGTLVHKSSSQGQDRFMIRMRQ LIDIVDQLKNYVNDLVPEFLPAPEDVETNCEWSAFSCFQDA QLKSANTGNNERIINVSIKKLKRKVPSTNAGRDQKHRLTCP SCDSYEKKPPKEFLERFKSLLQKMIHQHLSSRTHGSEDS | 0.639 | 947 |
| IL-21_5298 | K81D, V98E, T110D, R114Q | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSDNAGORQKHRLTCP SCDSYEKKPPKEFLERFKSLLQKMIHQHLSSRTHGSEDS | 0.64 | 948 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5486 | N70G, K81D, T110D, R115D | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSDNAGRDQKHRLTCP SCDSYEKKPPKEFLERFKSLLQKMIHQHLSSRTHGSEDS | 0.64 | 949 |
| IL-21_6318 | H35F, K81D, V98E | MRSSPGNMERIVICLMVIFLGTLVHKSSSQGQDREMIRMRQ LIDIVDQLKNYVNDLVPEFLPAPEDVETNCEWSAFSCFQDA QLKSANTGNNERIINESIKKLKRKPPSTNAGRRQKHRLTCP SCDSYEKKPPKEFLERFKSLLQKMIHQHLSSRTHGSEDS | 0.64 | 950 |
| IL-21_5273 | K81D, V98E, R115D, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGRDQKHTLTCP SCDSYEKKPPKEFLERFKSLLQKMIHQHLSSRTHGSEDS | 0.643 | 95 |
| IL-21_6002 | H35F, K81D, T110D, R115G | MRSSPGNMERIVICLMVIFLGTLVHKSSSQGQDREMIRMRQ LIDIVDQLKNYVNDLVPEFLPAPEDVETNCEWSAFSCFQDA QLKSANTGNNERIINVSIKKLKRKPPSDNAGRGQKHRLTCP SCDSYEKKPPKEFLERFKSLLQKMIHQHLSSRTHGSEDS | 0.643 | 952 |
| IL-21_5260 | K81D, P107V, T110D, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSDNAGRROKDRLTCP SCDSYEKKPPKEFLERFKSLLQKMIHQHLSSRTHGSEDS | 0.644 | 953 |
| IL-21_5292 | K81D, V98E, T110D, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSDNAGRROKHRLECP SCDSYEKKPPKEFLERFKSLLQKMIHQHLSSRTHGSEDS | 0.645 | 954 |
| IL-21_6160 | H35I, K81D, V98E, R115G | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINESIKKLKRKPPSTNAGRGQKHRLTCP SCDSYEKKPPKEFLERFKSLLQKMIHQHLSSRTHGSEDS | 0.645 | 955 |
| IL-21_5101 | V98E, A112P, R114Q, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGQDQKHRLTCP SCDSYEKKPPKEFLERFKSLLQKMIHQHLSSRTHGSEDS | 0.647 | 956 |
| IL-21_5281 | K81D, V98E, R114Q, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGORQKHTLTCP SCDSYEKKPPKEFLERFKSLLQKMIHQHLSSRTHGSEDS | 0.647 | 957 |
| IL-21_5999 | H35F, K81D, A112P, R115D | MRSSPGNMERIVICLMVIFLGTLVHKSSSQGQDRFMIRMRQ LIDIVDQLKNYVNDLVPEFLPAPEDVETNCEWSAFSCFQDA QLKSANTGNNERIINVSIKKLKRKPPSTNPGRDQKHRLTCP SCDSYEKKPPKEFLERFKSLLQKMIHQHLSSRTHGSEDS | 0.648 | 958 |
| IL-21_5158 | V98E, P107V, T110D, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSDNAGRDQKHRLTCP SCDSYEKKPPKEFLERFKSLLQKMIHQHLSSRTHGSEDS | 0.648 | 959 |
| IL-21_5274 | K81D, V98E, R115D, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGRDQKDRLTCP SCDSYEKKPPKEFLERFKSLLQKMIHQHLSSRTHGSEDS | 0.65 | 960 |
| IL-21_5487 | N70G, K81D, T110D, R114G | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSDNAGGROKHRLTCP SCDSYEKKPPKEFLERFKSLLQKMIHQHLSSRTHGSEDS | 0.651 | 96 |
| IL-21_5181 | K81D, R114Q, R115G, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGQGQKHRLECP SCDSYEKKPPKEFLERFKSLLQKMIHQHLSSRTHGSEDS | 0.651 | 962 |
| IL-21_6197 | H35I, N70G, K81D, T110D | MRSSPGNMERIVICLMVIFLGTLVHKSSSQGQDRIMIRMRQ LIDIVDQLKNYVNDLVPEFLPAPEDVETGCEWSAFSCFQDA QLKSANTGNNERIINVSIKKLKRKPPSDNAGRRQKHRLTCP SCDSYEKKPPKEFLERFKSLLQKMIHQHLSSRTHGSEDS | 0.651 | 963 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5474 | N70G, K81D, R114Q, R115D | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGQDQKHRLTCP SCDSYEKKPPKEFLERFKSLLQKMIHQHLSSRTHGSEDS | 0.652 | 964 |
| IL-21_6123 | H35I, V98E, R114G, R115D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKPPSTNAGGDQKHRLTCP SCDSYEKKPPKEFLERFKSLLQKMIHQHLSSRTHGSEDS | 0.655 | 965 |
| IL-21_5996 | H35F, K81D, R114Q, R115G | MRSSPGNMERIVICLMVIFLGTLVHKSSSQGQDREMIRMRQ LIDIVDQLKNYVNDLVPEFLPAPEDVETNCEWSAFSCFQDA QLKSANTGNNERIINVSIKKLKRKPPSTNAGQGQKHRLTCP SCDSYEKKPPKEFLERFKSLLQKMIHQHLSSRTHGSEDS | 0.656 | 966 |
| IL-21_5980 | H35F, V98E, A112P, R115D | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINESIKKLKRKPPSTNPGRDQKHRLTCP SCDSYEKKPPKEFLERFKSLLQKMIHQHLSSRTHGSEDS | 0.656 | 967 |
| IL-21_6358 | H35I, V98E, R115D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKPPSTNAGRDQKHRLTCP SCDSYEKKPPKEFLERFKSLLQKMIHQHLSSRTHGSEDS | 0.657 | 968 |
| IL-21_5288 | K81D, V98E, A112P, R115G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNPGRGQKHRLTCP SCDSYEKKPPKEFLERFKSLLQKMIHQHLSSRTHGSEDS | 0.661 | 969 |
| IL-21_5130 | V98E, P107V, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGRRQKDTLTCP SCDSYEKKPPKEFLERFKSLLQKMIHQHLSSRTHGSEDS | 0.663 | 970 |
| IL-21_5200 | K81D, A112P, R114G, R115D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGGDQKHRLTCP SCDSYEKKPPKEFLERFKSLLQKMIHQHLSSRTHGSEDS | 0.663 | 971 |
| IL-21_5300 | K81D, V98E, P107V, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKVPSTNAGRRQKHRLECP SCDSYEKKPPKEFLERFKSLLQKMIHQHLSSRTHGSEDS | 0.663 | 972 |
| IL-21_5295 | K81D, V98E, T110D, R115G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSDNAGRGQKHRLTCP SCDSYEKKPPKEFLERFKSLLQKMIHQHLSSRTHGSEDS | 0.663 | 973 |
| IL-21_5703 | K81D, V98E, R114G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGGROKHRLTCP SCDSYEKKPPKEFLERFKSLLQKMIHQHLSSRTHGSEDS | 0.665 | 974 |
| IL-21_5426 | N70G, V98E, R114G, R115D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGGDQKHRLTCP SCDSYEKKPPKEFLERFKSLLQKMIHQHLSSRTHGSEDS | 0.665 | 975 |
| IL-21_5994 | H35F, K81D, R114G, R115G | MRSSPGNMERIVICLMVIFLGTLVHKSSSQGQDREMIRMRQ LIDIVDQLKNYVNDLVPEFLPAPEDVETNCEWSAFSCFQDA QLKSANTGNNERIINVSIKKLKRKPPSTNAGGGQKHRLTCP SCDSYEKKPPKEFLERFKSLLQKMIHQHLSSRTHGSEDS | 0.665 | 976 |
| IL-21_5504 | N70G, K81D, V98E, R114G | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINESIKKLKRKPPSTNAGGRQKHRLTCP SCDSYEKKPPKEFLERFKSLLQKMIHQHLSSRTHGSEDS | 0.666 | 977 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_6019 | H35F, K81D, V98E, P107V | MRSSPGNMERIVICLMVIFLGTLVHKSSSQGQDREMIRMRQ LIDIVDQLKNYVNDLVPEFLPAPEDVETNCEWSAFSCFQDA QLKSANTGNNERIINESIKKLKRKVPSTNAGRRQKHRLTCP SCDSYEKKPPKEFLERFKSLLQKMIHQHLSSRTHGSEDS | 0.668 | 978 |
| IL-21_6142 | H35I, K81D, R114G, R115D | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSTNAGGDQKHRLTCP SCDSYEKKPPKEFLERFKSLLQKMIHQHLSSRTHGSEDS | 0.674 | 979 |
| IL-21_5143 | V98E, P107V, R114Q, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGQRQKHTLTCP SCDSYEKKPPKEFLERFKSLLQKMIHQHLSSRTHGSEDS | 0.675 | 980 |
| IL-21_5145 | V98E, P107V, R114Q, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGQGQKHRLTCP SCDSYEKKPPKEFLERFKSLLQKMIHQHLSSRTHGSEDS | 0.677 | 981 |
| IL-21_5472 | N70G, K81D, R114Q, H118D | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGQRQKDRLTCP SCDSYEKKPPKEFLERFKSLLQKMIHQHLSSRTHGSEDS | 0.677 | 982 |
| IL-21_5280 | K81D, V98E, R114Q, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGQRQKHRLECP SCDSYEKKPPKEFLERFKSLLQKMIHQHLSSRTHGSEDS | 0.679 | 983 |
| IL-21_5144 | V98E, P107V, R114Q, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGQRQKDRLTCP SCDSYEKKPPKEFLERFKSLLQKMIHQHLSSRTHGSEDS | 0.68 | 984 |
| IL-21_5500 | N70G, K81D, V98E, R119T | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINESIKKLKRKPPSTNAGRRQKHTLTCP SCDSYEKKPPKEFLERFKSLLQKMIHQHLSSRTHGSEDS | 0.68 | 985 |
| IL-21_5136 | V98E, P107V, R115D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGRDQKDRLTCP SCDSYEKKPPKEFLERFKSLLQKMIHQHLSSRTHGSEDS | 0.681 | 986 |
| IL-21_6132 | H35I, V98E, T110D, R114G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKPPSDNAGGRQKHRLTCP SCDSYEKKPPKEFLERFKSLLQKMIHQHLSSRTHGSEDS | 0.681 | 987 |
| IL-21_5469 | N70G, K81D, R114G, R115D | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGGDQKHRLTCP SCDSYEKKPPKEFLERFKSLLQKMIHQHLSSRTHGSEDS | 0.681 | 988 |
| IL-21_5704 | K81D, V98E, R114Q | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGQRQKHRLTCP SCDSYEKKPPKEFLERFKSLLQKMIHQHLSSRTHGSEDS | 0.682 | 989 |
| IL-21_5135 | V98E, P107V, R115D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGRDQKHTLTCP SCDSYEKKPPKEFLERFKSLLQKMIHQHLSSRTHGSEDS | 0.685 | 990 |
| IL-21_5630 | V98E, R114Q, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGQDQKHRLTCP SCDSYEKKPPKEFLERFKSLLQKMIHQHLSSRTHGSEDS | 0.685 | 991 |
| IL-21_5473 | N70G, K81D, R114Q, R115G | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGQGQKHRLTCP SCDSYEKKPPKEFLERFKSLLQKMIHQHLSSRTHGSEDS | 0.687 | 992 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5170 | K81D, R114G, H118D, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGGROKDRLECP SCDSYEKKPPKEFLERFKSLLQKMIHQHLSSRTHGSEDS | 0.687 | 993 |
| IL-21_5118 | V98E, T110D, R114Q, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGQRQKDRLTCP SCDSYEKKPPKEFLERFKSLLQKMIHQHLSSRTHGSEDS | 0.687 | 994 |
| IL-21_6124 | H35I, V98E, R114Q, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKPPSTNAGQGQKHRLTCP SCDSYEKKPPKEFLERFKSLLQKMIHQHLSSRTHGSEDS | 0.688 | 995 |
| IL-21_5834 | K81D, V98E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGRRQKHRLTCP SCDSYEKKPPKEFLERFKSLLQKMIHQHLSSRTHGSEDS | 0.689 | 996 |
| IL-21_5282 | K81D, V98E, R114Q, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGORQKDRLTCP SCDSYEKKPPKEFLERFKSLLQKMIHQHLSSRTHGSEDS | 0.691 | 997 |
| IL-21_5270 | K81D, V98E, R115G, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGRGQKHTLTCP SCDSYEKKPPKEFLERFKSLLQKMIHQHLSSRTHGSEDS | 0.691 | 998 |
| IL-21_6190 | H35I, N70G, V98E, T110D | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINESIKKLKRKPPSDNAGRRQKHRLTCP SCDSYEKKPPKEFLERFKSLLQKMIHQHLSSRTHGSEDS | 0.692 | 999 |
| IL-21_5166 | K81D, R115D, R119T, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRDQKHTLECP SCDSYEKKPPKEFLERFKSLLQKMIHQHLSSRTHGSEDS | 0.693 | 1000 |
| IL-21_5177 | K81D, R114G, R115D, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGGDQKDRLTCP SCDSYEKKPPKEFLERFKSLLQKMIHQHLSSRTHGSEDS | 0.693 | 1001 |
| IL-21_5141 | V98E, P107V, R114G, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGGDQKHRLTCP SCDSYEKKPPKEFLERFKSLLQKMIHQHLSSRTHGSEDS | 0.694 | 1002 |
| IL-21_5238 | K81D, P107V, R115D, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGRDQKHRLECP SCDSYEKKPPKEFLERFKSLLQKMIHQHLSSRTHGSEDS | 0.695 | 1003 |
| IL-21_5212 | K81D, T110D, R115D, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGRDQKHRLECP SCDSYEKKPPKEFLERFKSLLQKMIHQHLSSRTHGSEDS | 0.695 | 1004 |
| IL-21_6371 | H35I, K81D, V98E | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINESIKKLKRKPPSTNAGRRQKHRLTCP SCDSYEKKPPKEFLERFKSLLQKMIHQHLSSRTHGSEDS | 0.696 | 1005 |
| IL-21_5415 | N70G, V98E, H118D, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGRRQKDTLTCP SCDSYEKKPPKEFLERFKSLLQKMIHQHLSSRTHGSEDS | 0.697 | 1006 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5119 | V98E, T110D, R114Q, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGQGQKHRLTCP SCDSYEKKPPKEFLERFKSLLQKMIHQHLSSRTHGSEDS | 0.697 | 1007 |
| IL-21_5297 | K81D, V98E, T110D, R114G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSDNAGGROKHRLTCP SCDSYEKKPPKEFLERFKSLLQKMIHQHLSSRTHGSEDS | 0.697 | 1008 |
| IL-21_5233 | K81D, P107V, H118D, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGRRQKDRLECP SCDSYEKKPPKEFLERFKSLLQKMIHQHLSSRTHGSEDS | 0.698 | 1009 |
| IL-21_5291 | K81D, V98E, A112P, R114Q | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNPGQRQKHRLTCP SCDSYEKKPPKEFLERFKSLLQKMIHQHLSSRTHGSEDS | 0.698 | 1010 |
| IL-21_5977 | H35F, V98E, R114Q, R115G | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINESIKKLKRKPPSTNAGQGQKHRLTCP SCDSYEKKPPKEFLERFKSLLQKMIHQHLSSRTHGSEDS | 0.698 | 1011 |
| IL-21_5462 | N70G, K81D, R115D, T121E | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGRDQKHRLECP SCDSYEKKPPKEFLERFKSLLQKMIHQHLSSRTHGSEDS | 0.699 | 1012 |
| IL-21_5493 | N70G, K81D, P107V, R115G | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKVPSTNAGRGQKHRLTCP SCDSYEKKPPKEFLERFKSLLQKMIHQHLSSRTHGSEDS | 0.699 | 1013 |
| IL-21_5125 | V98E, T110D, A112P, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNPGRDQKHRLTCP SCDSYEKKPPKEFLERFKSLLQKMIHQHLSSRTHGSEDS | 0.701 | 1014 |
| IL-21_6005 | H35F, K81D, T110D, R114Q | MRSSPGNMERIVICLMVIFLGTLVHKSSSQGQDREMIRMRQ LIDIVDQLKNYVNDLVPEFLPAPEDVETNCEWSAFSCFQDA QLKSANTGNNERIINVSIKKLKRKPPSDNAGQRQKHRLTCP SCDSYEKKPPKEFLERFKSLLQKMIHQHLSSRTHGSEDS | 0.702 | 1015 |
| IL-21_5451 | N70G, V98E, P107V, R115D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKVPSTNAGRDQKHRLTCP SCDSYEKKPPKEFLERFKSLLQKMIHQHLSSRTHGSEDS | 0.704 | 1016 |
| IL-21_5693 | K81D, P107V, R115D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGRDQKHRLTCP SCDSYEKKPPKEFLERFKSLLQKMIHQHLSSRTHGSEDS | 0.705 | 1017 |
| IL-21_5498 | N70G, K81D, P107V, T110D | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKVPSDNAGRRQKHRLTCP SCDSYEKKPPKEFLERFKSLLQKMIHQHLSSRTHGSEDS | 0.707 | 1018 |
| IL-21_6162 | H35I, K81D, V98E, R114G | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINESIKKLKRKPPSTNAGGRQKHRLTCP SCDSYEKKPPKEFLERFKSLLQKMIHQHLSSRTHGSEDS | 0.708 | 1019 |
| IL-21_5301 | K81D, V98E, P107V, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKVPSTNAGRRQKHTLTCP SCDSYEKKPPKEFLERFKSLLQKMIHQHLSSRTHGSEDS | 0.71 | 1020 |
| IL-21_5211 | K81D, T110D, R115G, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGRGQKDRLTCP SCDSYEKKPPKEFLERFKSLLQKMIHQHLSSRTHGSEDS | 0.711 | 1021 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5430 | N70G, V98E, R114Q, R115G | MRSSPGNMERIVICLMVIFLGTLVHKSSSQGQDRHMIRMRQ<br>LIDIVDQLKNYVNDLVPEFLPAPEDVETGCEWSAFSCFQKA<br>QLKSANTGNNERIINESIKKLKRKPPSTNAGQGQKHRLTCP<br>SCDSYEKKPPKEFLERFKSLLQKMIHQHLSSRTHGSEDS | 0.711 | 1022 |
| IL-21_5284 | K81D, V98E, R114Q, R115D | MRSSPGNMERIVICLMVIFLGTLVHKSSSQGQDRHMIRMRQ<br>LIDIVDQLKNYVNDLVPEFLPAPEDVETNCEWSAFSCFQDA<br>QLKSANTGNNERIINESIKKLKRKPPSTNAGQDQKHRLTCP<br>SCDSYEKKPPKEFLERFKSLLQKMIHQHLSSRTHGSEDS | 0.712 | 1023 |
| IL-21_5223 | K81D, T110D, R114Q, R115G | MRSSPGNMERIVICLMVIFLGTLVHKSSSQGQDRHMIRMRQ<br>LIDIVDQLKNYVNDLVPEFLPAPEDVETNCEWSAFSCFQDA<br>QLKSANTGNNERIINVSIKKLKRKPPSDNAGQGQKHRLTCP<br>SCDSYEKKPPKEFLERFKSLLQKMIHQHLSSRTHGSEDS | 0.713 | 1024 |
| IL-21_6312 | H35F, K81D, R115D | MRSSPGNMERIVICLMVIFLGTLVHKSSSQGQDREMIRMRQ<br>LIDIVDQLKNYVNDLVPEFLPAPEDVETNCEWSAFSCFQDA<br>QLKSANTGNNERIINVSIKKLKRKPPSTNAGRDQKHRLTCP<br>SCDSYEKKPPKEFLERFKSLLQKMIHQHLSSRTHGSEDS | 0.713 | 1025 |
| IL-21_5234 | K81D, P107V, H118D, R119T | MRSSPGNMERIVICLMVIFLGTLVHKSSSQGQDRHMIRMRQ<br>LIDIVDQLKNYVNDLVPEFLPAPEDVETNCEWSAFSCFQDA<br>QLKSANTGNNERIINVSIKKLKRKVPSTNAGRRQKDTLTCP<br>SCDSYEKKPPKEFLERFKSLLQKMIHQHLSSRTHGSEDS | 0.713 | 1026 |
| IL-21_5467 | N70G, K81D, R114G, H118D | MRSSPGNMERIVICLMVIFLGTLVHKSSSQGQDRHMIRMRQ<br>LIDIVDQLKNYVNDLVPEFLPAPEDVETGCEWSAFSCFQDA<br>QLKSANTGNNERIINVSIKKLKRKPPSTNAGGROKDRLTCP<br>SCDSYEKKPPKEFLERFKSLLOKMIHQHLSSRTHGSEDS | 0.714 | 1027 |
| IL-21_6007 | H35F, K81D, P107V, R115G | MRSSPGNMERIVICLMVIFLGTLVHKSSSQGQDREMIRMRQ<br>LIDIVDQLKNYVNDLVPEFLPAPEDVETNCEWSAFSCFQDA<br>QLKSANTGNNERIINVSIKKLKRKVPSTNAGRGQKHRLTCP<br>SCDSYEKKPPKEFLERFKSLLQKMIHQHLSSRTHGSEDS | 0.714 | 1028 |
| IL-21_5081 | V98E, R114Q, R115D, R119T | MRSSPGNMERIVICLMVIFLGTLVHKSSSQGQDRHMIRMRQ<br>LIDIVDQLKNYVNDLVPEFLPAPEDVETNCEWSAFSCFQKA<br>QLKSANTGNNERIINESIKKLKRKPPSTNAGQDQKHTLTCP<br>SCDSYEKKPPKEFLERFKSLLQKMIHQHLSSRTHGSEDS | 0.716 | 1029 |
| IL-21_5213 | K81D, T110D, R115D, R119T | MRSSPGNMERIVICLMVIFLGTLVHKSSSQGQDRHMIRMRQ<br>LIDIVDQLKNYVNDLVPEFLPAPEDVETNCEWSAFSCFQDA<br>QLKSANTGNNERIINVSIKKLKRKPPSDNAGRDQKHTLTCP<br>SCDSYEKKPPKEFLERFKSLLQKMIHQHLSSRTHGSEDS | 0.718 | 1030 |
| IL-21_5219 | K81D, T110D, R114G, R115D | MRSSPGNMERIVICLMVIFLGTLVHKSSSQGQDRHMIRMRQ<br>LIDIVDQLKNYVNDLVPEFLPAPEDVETNCEWSAFSCFQDA<br>QLKSANTGNNERIINVSIKKLKRKPPSDNAGGDQKHRLTCP<br>SCDSYEKKPPKEFLERFKSLLQKMIHQHLSSRTHGSEDS | 0.718 | 1031 |
| IL-21_5108 | V98E, T110D, R115D, T121E | MRSSPGNMERIVICLMVIFLGTLVHKSSSQGQDRHMIRMRQ<br>LIDIVDQLKNYVNDLVPEFLPAPEDVETNCEWSAFSCFQKA<br>QLKSANTGNNERIINESIKKLKRKPPSDNAGRDQKHRLECP<br>SCDSYEKKPPKEFLERFKSLLQKMIHQHLSSRTHGSEDS | 0.718 | 1032 |
| IL-21_5248 | K81D, P107V, R114Q, H118D | MRSSPGNMERIVICLMVIFLGTLVHKSSSQGQDRHMIRMRQ<br>LIDIVDQLKNYVNDLVPEFLPAPEDVETNCEWSAFSCFQDA<br>QLKSANTGNNERIINVSIKKLKRKVPSTNAGQRQKDRLTCP<br>SCDSYEKKPPKEFLERFKSLLOKMIHQHLSSRTHGSEDS | 0.718 | 1033 |
| IL-21_5289 | K81D, V98E, A112P, R115D | MRSSPGNMERIVICLMVIFLGTLVHKSSSQGQDRHMIRMRQ<br>LIDIVDQLKNYVNDLVPEFLPAPEDVETNCEWSAFSCFQDA<br>QLKSANTGNNERIINESIKKLKRKPPSTNPGRDQKHRLTCP<br>SCDSYEKKPPKEFLERFKSLLQKMIHQHLSSRTHGSEDS | 0.72 | 1034 |
| IL-21_5067 | V98E, R114G, H118D, R119T | MRSSPGNMERIVICLMVIFLGTLVHKSSSQGQDRHMIRMRQ<br>LIDIVDQLKNYVNDLVPEFLPAPEDVETNCEWSAFSCFQKA<br>QLKSANTGNNERIINESIKKLKRKPPSTNAGGROKDTLTCP<br>SCDSYEKKPPKEFLERFKSLLQKMIHQHLSSRTHGSEDS | 0.72 | 1035 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_6051 | H35F, N70G, K81D, T110D | MRSSPGNMERIVICLMVIFLGTLVHKSSSQGQDRFMIRMRQ LIDIVDQLKNYVNDLVPEFLPAPEDVETGCEWSAFSCFQDA QLKSANTGNNERIINVSIKKLKRKPPSDNAGRRQKHRLTCP SCDSYEKKPPKEFLERFKSLLQKMIHQHLSSRTHGSEDS | 0.72 | 1036 |
| IL-21_6127 | H35I, V98E, A112P, R115D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKPPSTNPGRDQKHRLTCP SCDSYEKKPPKEFLERFKSLLQKMIHQHLSSRTHGSEDS | 0.72 | 1037 |
| IL-21_5425 | N70G, V98E, R114G, R115G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGGGQKHRLTCP SCDSYEKKPPKEFLERFKSLLQKMIHQHLSSRTHGSEDS | 0.722 | 1038 |
| IL-21_5074 | V98E, R114Q, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGQRQKHTLECP SCDSYEKKPPKEFLERFKSLLQKMIHQHLSSRTHGSEDS | 0.722 | 1039 |
| IL-21_5442 | N70G, V98E, T110D, R115G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSDNAGRGQKHRLTCP SCDSYEKKPPKEFLERFKSLLQKMIHQHLSSRTHGSEDS | 0.722 | 1040 |
| IL-21_6144 | H35I, K81D, R114Q, R115D | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSTNAGQDQKHRLTCP SCDSYEKKPPKEFLERFKSLLQKMIHQHLSSRTHGSEDS | 0.723 | 1041 |
| IL-21_5221 | K81D, T110D, R114Q, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGQRQKHTLTCP SCDSYEKKPPKEFLERFKSLLQKMIHQHLSSRTHGSEDS | 0.723 | 1042 |
| IL-21_6010 | H35F, K81D, P107V, R114Q | MRSSPGNMERIVICLMVIFLGTLVHKSSSQGQDREMIRMRQ LIDIVDQLKNYVNDLVPEFLPAPEDVETNCEWSAFSCFQDA QLKSANTGNNERIINVSIKKLKRKVPSTNAGQRQKHRLTCP SCDSYEKKPPKEFLERFKSLLQKMIHQHLSSRTHGSEDS | 0.724 | 1043 |
| IL-21_6000 | H35F, K81D, A112P, R114G | MRSSPGNMERIVICLMVIFLGTLVHKSSSQGQDRFMIRMRQ LIDIVDQLKNYVNDLVPEFLPAPEDVETNCEWSAFSCFQDA QLKSANTGNNERIINVSIKKLKRKPPSTNPGGRQKHRLTCP SCDSYEKKPPKEFLERFKSLLQKMIHQHLSSRTHGSEDS | 0.724 | 1044 |
| IL-21_5701 | K81D, V98E, R115G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGRGQKHRLTCP SCDSYEKKPPKEFLERFKSLLQKMIHQHLSSRTHGSEDS | 0.724 | 1045 |
| IL-21_6136 | H35I, V98E, P107V, R115D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKVPSTNAGRDQKHRLTCP SCDSYEKKPPKEFLERFKSLLQKMIHQHLSSRTHGSEDS | 0.726 | 1046 |
| IL-21_5080 | V98E, R114Q, R115D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGQDQKHRLECP SCDSYEKKPPKEFLERFKSLLQKMIHQHLSSRTHGSEDS | 0.727 | 1047 |
| IL-21_5204 | K81D, A112P, R114Q, R115G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGQGQKHRLTCP SCDSYEKKPPKEFLERFKSLLQKMIHQHLSSRTHGSEDS | 0.727 | 1048 |
| IL-21_5899 | I45T, K81D, T110D, R115D | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKPPSDNAGRDQKHRLTCP SCDSYEKKPPKEFLERFKSLLQKMIHQHLSSRTHGSEDS | 0.729 | 1049 |
| IL-21_5140 | V98E, P107V, R114G, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGGGQKHRLTCP SCDSYEKKPPKEFLERFKSLLQKMIHQHLSSRTHGSEDS | 0.729 | 1050 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_6001 | H35F, K81D, A112P, R114Q | MRSSPGNMERIVICLMVIFLGTLVHKSSSQGQDRFMIRMRQ LIDIVDQLKNYVNDLVPEFLPAPEDVETNCEWSAFSCFQDA QLKSANTGNNERIINVSIKKLKRKPPSTNPGQRQKHRLTCP SCDSYEKKPPKEFLERFKSLLQKMIHQHLSSRTHGSEDS | 0.729 | 1051 |
| IL-21_5264 | K81D, P107V, T110D, R114Q | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSDNAGQRQKHRLTCP SCDSYEKKPPKEFLERFKSLLQKMIHQHLSSRTHGSEDS | 0.73 | 1052 |
| IL-21_5755 | N70G, V98E, 1R15D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGRDQKHRLTCP SCDSYEKKPPKEFLERFKSLLQKMIHQHLSSRTHGSEDS | 0.73 | 1053 |
| IL-21_5096 | V98E, A112P, R114G, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGGDQKHRLTCP SCDSYEKKPPKEFLERFKSLLQKMIHQHLSSRTHGSEDS | 0.73 | 1054 |
| IL-21_6131 | H35I, V98E, T110D, R115D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKPPSDNAGRDQKHRLTCP SCDSYEKKPPKEFLERFKSLLQKMIHQHLSSRTHGSEDS | 0.73 | 1055 |
| IL-21_5294 | K81D, V98E, T110D, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSDNAGRRQKDRLTCP SCDSYEKKPPKEFLERFKSLLQKMIHQHLSSRTHGSEDS | 0.73 | 1056 |
| IL-21_5216 | K81D, T110D, R114G, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGGRQKHTLTCP SCDSYEKKPPKEFLERFKSLLQKMIHQHLSSRTHGSEDS | 0.731 | 1057 |
| IL-21_5243 | K81D, P107V, R114G, H118 D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGGRQKDRLTCP SCDSYEKKPPKEFLERFKSLLQKMIHQHLSSRTHGSEDS | 0.731 | 1058 |
| IL-21_6130 | H35I, V98E, T110D, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKPPSDNAGRGQKHRLTCP SCDSYEKKPPKEFLERFKSLLQKMIHQHLSSRTHGSEDS | 0.731 | 1059 |
| IL-21_5259 | K81D, P107V, T110D, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSDNAGRRQKHTLTCP SCDSYEKKPPKEFLERFKSLLQKMIHQHLSSRTHGSEDS | 0.731 | 1060 |
| IL-21_5441 | N70G, V98E, T110D, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSDNAGRRQKDRLTCP SCDSYEKKPPKEFLERFKSLLQKMIHQHLSSRTHGSEDS | 0.731 | 1061 |
| IL-21_5069 | V98E, R114G, R115G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGGGQKHTLTCP SCDSYEKKPPKEFLERFKSLLQKMIHQHLSSRTHGSEDS | 0.731 | 1062 |
| IL-21_6048 | H35F, N70G, K81D, R114G | MRSSPGNMERIVICLMVIFLGTLVHKSSSQGQDRFMIRMRQ LIDIVDQLKNYVNDLVPEFLPAPEDVETGCEWSAFSCFQDA QLKSANTGNNERIINVSIKKLKRKPPSTNAGGRQKHRLTCP SCDSYEKKPPKEFLERFKSLLQKMIHQHLSSRTHGSEDS | 0.732 | 1063 |
| IL-21_5466 | N70G, K81D, R114G, R119T | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGGRQKHTLTCP SCDSYEKKPPKEFLERFKSLLQKMIHQHLSSRTHGSEDS | 0.733 | 1064 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5278 | K81D, V98E, R114G, R115G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGGGQKHRLTCP SCDSYEKKPPKEFLERFKSLLQKMIHQHLSSRTHGSEDS | 0.733 | 1065 |
| IL-21_5275 | K81D, V98E, R114G, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGGRQKHRLECP SCDSYEKKPPKEFLERFKSLLQKMIHQHLSSRTHGSEDS | 0.733 | 1066 |
| IL-21_5117 | V98E, T110D, R114Q, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGQRQKHTLTCP SCDSYEKKPPKEFLERFKSLLQKMIHQHLSSRTHGSEDS | 0.733 | 1067 |
| IL-21_6047 | H35F, N70G, K81D, R115D | MRSSPGNMERIVICLMVIFLGTLVHKSSSQGQDREMIRMRQ LIDIVDQLKNYVNDLVPEFLPAPEDVETGCEWSAFSCFQDA QLKSANTGNNERIINVSIKKLKRKPPSTNAGRDQKHRLTCP SCDSYEKKPPKEFLERFKSLLQKMIHQHLSSRTHGSEDS | 0.733 | 1068 |
| IL-21_5203 | K81D, A112P, R114Q, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGQRQKDRLTCP SCDSYEKKPPKEFLERFKSLLQKMIHQHLSSRTHGSEDS | 0.734 | 1069 |
| IL-21_5495 | N70G, K81D, 1P07V, R114G | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKVPSTNAGGRQKHRLTCP SCDSYEKKPPKEFLERFKSLLQKMIHQHLSSRTHGSEDS | 0.737 | 1070 |
| IL-21_5414 | N70G, V98E, H118D, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGRRQKDRLECP SCDSYEKKPPKEFLERFKSLLQKMIHQHLSSRTHGSEDS | 0.737 | 1071 |
| IL-21_5244 | K81D, P107V, R114G, R115G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGGGQKHRLTCP SCDSYEKKPPKEFLERFKSLLQKMIHQHLSSRTHGSEDS | 0.737 | 1072 |
| IL-21_6046 | H35F, N70G, K81D, R115G | MRSSPGNMERIVICLMVIFLGTLVHKSSSQGQDRFMIRMRQ LIDIVDQLKNYVNDLVPEFLPAPEDVETGCEWSAFSCFQDA QLKSANTGNNERIINVSIKKLKRKPPSTNAGRGQKHRLTCP SCDSYEKKPPKEFLERFKSLLQKMIHQHLSSRTHGSEDS | 0.738 | 1073 |
| IL-21_6154 | H35I, K81D, P107V, R115G | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKVPSTNAGRGQKHRLTCP SCDSYEKKPPKEFLERFKSLLQKMIHQHLSSRTHGSEDS | 0.738 | 1074 |
| IL-21_6185 | H35I, N70G, V98E, R115G | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINESIKKLKRKPPSTNAGRGQKHRLTCP SCDSYEKKPPKEFLERFKSLLQKMIHQHLSSRTHGSEDS | 0.738 | 1075 |
| IL-21_6053 | H35F, N70G, 8K1D, V98E | MRSSPGNMERIVICLMVIFLGTLVHKSSSQGQDREMIRMRQ LIDIVDQLKNYVNDLVPEFLPAPEDVETGCEWSAFSCFQDA QLKSANTGNNERIINESIKKLKRKPPSTNAGRRQKHRLTCP SCDSYEKKPPKEFLERFKSLLQKMIHQHLSSRTHGSEDS | 0.739 | 1076 |
| IL-21_5077 | V98E, R114Q, R115G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGQGQKHRLECP SCDSYEKKPPKEFLERFKSLLQKMIHQHLSSRTHGSEDS | 0.739 | 1077 |
| IL-21_5245 | K81D, P107V, R114G, R115D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGGDQKHRLTCP SCDSYEKKPPKEFLERFKSLLQKMIHQHLSSRTHGSEDS | 0.74 | 1078 |
| IL-21_6229 | H35I, I45T, K81D, R114Q | MRSSPGNMERIVICLMVIFLGTLVHKSSSQGQDRIMIRMRQ LIDTVDQLKNYVNDLVPEFLPAPEDVETNCEWSAFSCFQDA QLKSANTGNNERIINVSIKKLKRKPPSTNAGQRQKHRLTCP SCDSYEKKPPKEFLERFKSLLQKMIHQHLSSRTHGSEDS | 0.74 | 1079 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5464 | N70G, K81D, R115D, H118D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGRDQKDRLTCPSCDSYEKKPPKEFLERFKSLLQKMIHQHLSSRTHGSEDS | 0.74 | 1080 |
| IL-21_5217 | K81D, T110D, R114G, H118D | MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGGRQKDRLTCPSCDSYEKKPPKEFLERFKSLLQKMIHQHLSSRTHGSEDS | 0.74 | 1081 |
| IL-21_5261 | K81D, P107V, T110D, R115G | MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSDNAGRGQKHRLTCPSCDSYEKKPPKEFLERFKSLLQKMIHQHLSSRTHGSEDS | 0.74 | 1082 |
| IL-21_5501 | N70G, K81D, V98E, H118D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINESIKKLKRKPPSTNAGRRQKDRLTCPSCDSYEKKPPKEFLERFKSLLQKMIHQHLSSRTHGSEDS | 0.74 | 1083 |
| IL-21_5179 | K81D, R114Q, H118D, T121E | MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGQRQKDRLECPSCDSYEKKPPKEFLERFKSLLQKMIHQHLSSRTHGSEDS | 0.741 | 1084 |
| IL-21_5436 | N70G, V98E, A112P, R115D | MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNPGRDQKHRLTCPSCDSYEKKPPKEFLERFKSLLQKMIHQHLSSRTHGSEDS | 0.742 | 1085 |
| IL-21_6081 | H35F, I45T, 1K8D, R115D | MRSSPGNMERIVICLMVIFLGTLVHKSSSQGQDREMIRMRQLIDTVDQLKNYVNDLVPEFLPAPEDVETNCEWSAFSCFQDAQLKSANTGNNERIINVSIKKLKRKPPSTNAGRDQKHRLTCPSCDSYEKKPPKEFLERFKSLLQKMIHQHLSSRTHGSEDS | 0.742 | 1086 |
| IL-21_5114 | V98E, T110D, R114G, R115G | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGGGQKHRLTCPSCDSYEKKPPKEFLERFKSLLQKMIHQHLSSRTHGSEDS | 0.742 | 1087 |
| IL-21_5078 | V98E, R114Q, R115G, R119T | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGQGQKHTLTCPSCDSYEKKPPKEFLERFKSLLQKMIHQHLSSRTHGSEDS | 0.743 | 1088 |
| IL-21_5949 | I45T, N70G, K81D, V98E | MRSSPGNMERIVICLMVIFLGTLVHKSSSQGQDRHMIRMRQLIDTVDQLKNYVNDLVPEFLPAPEDVETGCEWSAFSCFQDAQLKSANTGNNERIINESIKKLKRKPPSTNAGRRQKHRLTCPSCDSYEKKPPKEFLERFKSLLQKMIHQHLSSRTHGSEDS | 0.743 | 1089 |
| IL-21_5103 | V98E, T110D, H118D, T121E | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGRRQKDRLECPSCDSYEKKPPKEFLERFKSLLQKMIHQHLSSRTHGSEDS | 0.744 | 1090 |
| IL-21_5062 | V98E, R115D, R119T, T121E | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRDQKHTLECPSCDSYEKKPPKEFLERFKSLLQKMIHQHLSSRTHGSEDS | 0.744 | 1091 |
| IL-21_5984 | H35F, V98E, T110D, R115D | MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSDNAGRDQKHRLTCPSCDSYEKKPPKEFLERFKSLLQKMIHQHLSSRTHGSEDS | 0.745 | 1092 |
| IL-21_6164 | H35I, K81D, V98E, A112P | MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINESIKKLKRKPPSTNPGRRQKHRLTCPSCDSYEKKPPKEFLERFKSLLQKMIHQHLSSRTHGSEDS | 0.746 | 1093 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5242 | K81D, P107V, R114G, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGGRQKHTLTCP SCDSYEKKPPKEFLERFKSLLQKMIHQHLSSRTHGSEDS | 0.746 | 1094 |
| IL-21_5214 | K81D, T110D, R115D, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGRDQKDRLTCP SCDSYEKKPPKEFLERFKSLLQKMIHQHLSSRTHGSEDS | 0.747 | 1095 |
| IL-21_5485 | N70G, K81D, T110D, R115G | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSDNAGRGQKHRLTCP SCDSYEKKPPKEFLERFKSLLQKMIHQHLSSRTHGSEDS | 0.747 | 1096 |
| IL-21_5186 | K81D, R114Q, R115D, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGQDQKDRLTCP SCDSYEKKPPKEFLERFKSLLQKMIHQHLSSRTHGSEDS | 0.748 | 1097 |
| IL-21_6009 | H35F, K81D, 1P07V, R114G | MRSSPGNMERIVICLMVIFLGTLVHKSSSQGQDREMIRMRQ LIDIVDQLKNYVNDLVPEFLPAPEDVETNCEWSAFSCFQDA QLKSANTGNNERIINVSIKKLKRKVPSTNAGGRQKHRLTCP SCDSYEKKPPKEFLERFKSLLQKMIHQHLSSRTHGSEDS | 0.749 | 1098 |
| IL-21_5494 | N70G, K81D, P107V, R115D | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKVPSTNAGRDQKHRLTCP SCDSYEKKPPKEFLERFKSLLQKMIHQHLSSRTHGSEDS | 0.75 | 1099 |
| IL-21_5424 | N70G, V98E, R114G, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGGRQKDRLTCP SCDSYEKKPPKEFLERFKSLLQKMIHQHLSSRTHGSEDS | 0.75 | 1100 |
| IL-21_5499 | N70G, K81D, V98E, T121E | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINESIKKLKRKPPSTNAGRRQKHRLECP SCDSYEKKPPKEFLERFKSLLQKMIHQHLSSRTHGSEDS | 0.751 | 1101 |
| IL-21_5156 | V98E, P107V, T110D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSDNAGRRQKDRLTCP SCDSYEKKPPKEFLERFKSLLQKMIHQHLSSRTHGSEDS | 0.752 | 1102 |
| IL-21_5109 | V98E, T110D, R115D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGRDQKHTLTCP SCDSYEKKPPKEFLERFKSLLQKMIHQHLSSRTHGSEDS | 0.752 | 1103 |
| IL-21_6220 | H351, I45T, V98E, R115D | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINESIKKLKRKPPSTNAGRDQKHRLTCP SCDSYEKKPPKEFLERFKSLLQKMIHQHLSSRTHGSEDS | 0.753 | 1104 |
| IL-21_5184 | K81D, R114Q, R115D, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGQDQKHRLECP SCDSYEKKPPKEFLERFKSLLQKMIHQHLSSRTHGSEDS | 0.753 | 1105 |
| IL-21_5420 | N70G, V98E, R115D, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGRDQKHTLTCP SCDSYEKKPPKEFLERFKSLLQKMIHQHLSSRTHGSEDS | 0.755 | 1106 |
| IL-21_5673 | K81D, R114Q, R115D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGQDQKHRLTCP SCDSYEKKPPKEFLERFKSLLQKMIHQHLSSRTHGSEDS | 0.755 | 1107 |
| IL-21_5255 | K81D, P107V, A112P, R115D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNPGRDQKHRLTCP SCDSYEKKPPKEFLERFKSLLQKMIHQHLSSRTHGSEDS | 0.756 | 1108 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5506 | N70G, K81D, V98E, A112P | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINESIKKLKRKPPSTNPGRRQKHRLTCP SCDSYEKKPPKEFLERFKSLLQKMIHQHLSSRTHGSEDS | 0.756 | 1109 |
| IL-21_5195 | K81D, A112P, R115D, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGRDQKDRLTCP SCDSYEKKPPKEFLERFKSLLQKMIHQHLSSRTHGSEDS | 0.757 | 1110 |
| IL-21_5361 | N70G, T110D, R115D, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGRDQKDRLTCP SCDSYEKKPPKEFLERFKSLLQKMIHQHLSSRTHGSEDS | 0.757 | 1111 |
| IL-21_5908 | I45T, K81D, P107V, T110D | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKVPSDNAGRRQKHRLTCP SCDSYEKKPPKEFLERFKSLLQKMIHQHLSSRTHGSEDS | 0.758 | 1112 |
| IL-21_5123 | V98E, T110D, A112P, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNPGRRQKDRLTCP SCDSYEKKPPKEFLERFKSLLQKMIHQHLSSRTHGSEDS | 0.759 | 1113 |
| IL-21_5240 | K81D, P107V, R115D, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGRDQKDRLTCP SCDSYEKKPPKEFLERFKSLLQKMIHQHLSSRTHGSEDS | 0.759 | 1114 |
| IL-21_5163 | K81D, R115G, R119T, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRGQKHTLECP SCDSYEKKPPKEFLERFKSLLQKMIHQHLSSRTHGSEDS | 0.761 | 1115 |
| IL-21_5667 | K81D, R114G, R115G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGGGQKHRLTCP SCDSYEKKPPKEFLERFKSLLQKMIHQHLSSRTHGSEDS | 0.761 | 1116 |
| IL-21_5209 | K81D, T110D, R115G, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGRGQKHRLECP SCDSYEKKPPKEFLERFKSLLQKMIHQHLSSRTHGSEDS | 0.762 | 1117 |
| IL-21_6311 | H35F, K81D, R115G | MRSSPGNMERIVICLMVIFLGTLVHKSSSQGQDRFMIRMRQ LIDIVDQLKNYVNDLVPEFLPAPEDVETNCEWSAFSCFQDA QLKSANTGNNERIINVSIKKLKRKPPSTNAGRGQKHRLTCP SCDSYEKKPPKEFLERFKSLLQKMIHQHLSSRTHGSEDS | 0.763 | 1118 |
| IL-21_5105 | V98E, T110D, R115G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGRGQKHRLECP SCDSYEKKPPKEFLERFKSLLQKMIHQHLSSRTHGSEDS | 0.764 | 1119 |
| IL-21_5979 | H35F, V98E, A112P, R115G | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINESIKKLKRKPPSTNPGRGQKHRLTCP SCDSYEKKPPKEFLERFKSLLQKMIHQHLSSRTHGSEDS | 0.764 | 1120 |
| IL-21_5129 | V98E, P107V, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGRRQKDRLECP SCDSYEKKPPKEFLERFKSLLQKMIHQHLSSRTHGSEDS | 0.765 | 1121 |
| IL-21_5180 | K81D, R114Q, H118D, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGQRQKDTLTCP SCDSYEKKPPKEFLERFKSLLQKMIHQHLSSRTHGSEDS | 0.765 | 1122 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5157 | V98E, P107V, T110D, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSDNAGRGQKHRLTCP SCDSYEKKPPKEFLERFKSLLQKMIHQHLSSRTHGSEDS | 0.765 | 1123 |
| IL-21_6126 | H35I, V98E, A112P, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKPPSTNPGRGQKHRLTCP SCDSYEKKPPKEFLERFKSLLQKMIHQHLSSRTHGSEDS | 0.766 | 1124 |
| IL-21_5070 | V98E, R114G, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGGGQKDRLTCP SCDSYEKKPPKEFLERFKSLLQKMIHQHLSSRTHGSEDS | 0.766 | 1125 |
| IL-21_5623 | V98E, R114G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGGRQKDRLTCP SCDSYEKKPPKEFLERFKSLLQKMIHQHLSSRTHGSEDS | 0.767 | 1126 |
| IL-21_5066 | V98E, R114G, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGGRQKDRLECP SCDSYEKKPPKEFLERFKSLLQKMIHQHLSSRTHGSEDS | 0.767 | 1127 |
| IL-21_5229 | K81D, T110D, A112P, R115D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNPGRDQKHRLTCP SCDSYEKKPPKEFLERFKSLLQKMIHQHLSSRTHGSEDS | 0.768 | 1128 |
| IL-21_6199 | H35I, N70G, K81D, V98E | MRSSPGNMERIVICLMVIFLGTLVHKSSSQGQDRIMIRMRQ LIDIVDQLKNYVNDLVPEFLPAPEDVETGCEWSAFSCFQDA QLKSANTGNNERIINESIKKLKRKPPSTNAGRRQKHRLTCP SCDSYEKKPPKEFLERFKSLLQKMIHQHLSSRTHGSEDS | 0.768 | 1129 |
| IL-21_6074 | H35F, I45T, V98E, R115D | MRSSPGNMERIVICLMVIFLGTLVHKSSSQGQDRFMIRMRQ LIDTVDQLKNYVNDLVPEFLPAPEDVETNCEWSAFSCFQKA QLKSANTGNNERIINESIKKLKRKPPSTNAGRDQKHRLTCP SCDSYEKKPPKEFLERFKSLLQKMIHQHLSSRTHGSEDS | 0.768 | 1130 |
| IL-21_5419 | N70G, V98E, R115D, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGRDQKHRLECP SCDSYEKKPPKEFLERFKSLLQKMIHQHLSSRTHGSEDS | 0.769 | 1131 |
| IL-21_5507 | N70G, K81D, V98E, T110D | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINESIKKLKRKPPSDNAGRRQKHRLTCP SCDSYEKKPPKEFLERFKSLLQKMIHQHLSSRTHGSEDS | 0.77 | 1132 |
| IL-21_6187 | H35I, N70G, V98E, R114G | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINESIKKLKRKPPSTNAGGRQKHRLTCP SCDSYEKKPPKEFLERFKSLLQKMIHQHLSSRTHGSEDS | 0.772 | 1133 |
| IL-21_5910 | I45T, K81D, V98E, R115D | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINESIKKLKRKPPSTNAGRDQKHRLTCP SCDSYEKKPPKEFLERFKSLLQKMIHQHLSSRTHGSEDS | 0.773 | 1134 |
| IL-21_5088 | V98E, A112P, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGRGQKDRLTCP SCDSYEKKPPKEFLERFKSLLQKMIHQHLSSRTHGSEDS | 0.774 | 1135 |
| IL-21_5139 | V98E, P107V, R114G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGGRQKDRLTCP SCDSYEKKPPKEFLERFKSLLQKMIHQHLSSRTHGSEDS | 0.774 | 1136 |
| IL-21_5616 | V98E, R115G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRGQKHTLTCP SCDSYEKKPPKEFLERFKSLLQKMIHQHLSSRTHGSEDS | 0.775 | 1137 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5687 | K81D, T110D, R114Q | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGQRQKHRLTCP SCDSYEKKPPKEFLERFKSLLQKMIHQHLSSRTHGSEDS | 0.777 | 1138 |
| IL-21_5463 | N70G, K81D, R115D, R119T | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGRDQKHTLTCP SCDSYEKKPPKEFLERFKSLLQKMIHQHLSSRTHGSEDS | 0.777 | 1139 |
| IL-21_5483 | N70G, K81D, T110D, R119T | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSDNAGRRQKHTLTCP SCDSYEKKPPKEFLERFKSLLQKMIHQHLSSRTHGSEDS | 0.777 | 1140 |
| IL-21_5684 | K81D, T110D, R115G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGRGQKHRLTCP SCDSYEKKPPKEFLERFKSLLQKMIHQHLSSRTHGSEDS | 0.777 | 1141 |
| IL-21_6133 | H35I, V98E, T110D, R114Q | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKPPSDNAGQRQKHRLTCP SCDSYEKKPPKEFLERFKSLLQKMIHQHLSSRTHGSEDS | 0.778 | 1142 |
| IL-21_6155 | H35I, K81D, P107V, R115D | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKVPSTNAGRDQKHRLTCP SCDSYEKKPPKEFLERFKSLLQKMIHQHLSSRTHGSEDS | 0.778 | 1143 |
| IL-21_5076 | V98E, R114Q, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGQRQKDTLTCP SCDSYEKKPPKEFLERFKSLLQKMIHQHLSSRTHGSEDS | 0.778 | 1144 |
| IL-21_5686 | K81D, T110D, R114G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGGRQKHRLTCP SCDSYEKKPPKEFLERFKSLLQKMIHQHLSSRTHGSEDS | 0.779 | 1145 |
| IL-21_5208 | K81D, T110D, H118D, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGRRQKDTLTCP SCDSYEKKPPKEFLERFKSLLQKMIHQHLSSRTHGSEDS | 0.779 | 1146 |
| IL-21_5175 | K81D, R114G, R115D, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGGDQKHRLECP SCDSYEKKPPKEFLERFKSLLQKMIHQHLSSRTHGSEDS | 0.78 | 1147 |
| IL-21_5418 | N70G, V98E, R115G, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGRGQKDRLTCP SCDSYEKKPPKEFLERFKSLLQKMIHQHLSSRTHGSEDS | 0.78 | 1148 |
| IL-21_5185 | K81D, R114Q, R115D, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGQDQKHTLTCP SCDSYEKKPPKEFLERFKSLLQKMIHQHLSSRTHGSEDS | 0.781 | 1149 |
| IL-21_5155 | V98E, P107V, T110D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSDNAGRRQKHTLTCP SCDSYEKKPPKEFLERFKSLLQKMIHQHLSSRTHGSEDS | 0.781 | 1150 |
| IL-21_5060 | V98E, R115G, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRGQKDRLECP SCDSYEKKPPKEFLERFKSLLQKMIHQHLSSRTHGSEDS | 0.781 | 1151 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5171 | K81D, R114G, H118D, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGGRQKDTLTCP SCDSYEKKPPKEFLERFKSLLQKMIHQHLSSRTHGSEDS | 0.782 | 1152 |
| IL-21_5132 | V98E, P107V, R115G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGRGQKHTLTCP SCDSYEKKPPKEFLERFKSLLQKMIHQHLSSRTHGSEDS | 0.783 | 1153 |
| IL-21_5134 | V98E, P107V, R115D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGRDQKHRLECP SCDSYEKKPPKEFLERFKSLLQKMIHQHLSSRTHGSEDS | 0.783 | 1154 |
| IL-21_5983 | H35F, V98E, T110D, R115G | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINESIKKLKRKPPSDNAGRGQKHRLTCP SCDSYEKKPPKEFLERFKSLLQKMIHQHLSSRTHGSEDS | 0.784 | 1155 |
| IL-21_5906 | I45T, K81D, P107V, R114Q | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKVPSTNAGQRQKHRLTCP SCDSYEKKPPKEFLERFKSLLQKMIHQHLSSRTHGSEDS | 0.784 | 1156 |
| IL-21_5911 | I45T, K81D, V98E, R114G | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINESIKKLKRKPPSTNAGGRQKHRLTCP SCDSYEKKPPKEFLERFKSLLQKMIHQHLSSRTHGSEDS | 0.786 | 1157 |
| IL-21_5262 | K81D, P107V, T110D, R115D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSDNAGRDQKHRLTCP SCDSYEKKPPKEFLERFKSLLQKMIHQHLSSRTHGSEDS | 0.788 | 1158 |
| IL-21_5998 | H35F, K81D, A112P, R115G | MRSSPGNMERIVICLMVIFLGTLVHKSSSQGQDRFMIRMRQ LIDIVDQLKNYVNDLVPEFLPAPEDVETNCEWSAFSCFQDA QLKSANTGNNERIINVSIKKLKRKPPSTNPGRGQKHRLTCP SCDSYEKKPPKEFLERFKSLLQKMIHQHLSSRTHGSEDS | 0.788 | 1159 |
| IL-21_5505 | N70G, K81D, V98E, R114Q | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINESIKKLKRKPPSTNAGQRQKHRLTCP SCDSYEKKPPKEFLERFKSLLQKMIHQHLSSRTHGSEDS | 0.789 | 1160 |
| IL-21_5699 | K81D, V98E, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGRRQKHTLTCP SCDSYEKKPPKEFLERFKSLLQKMIHQHLSSRTHGSEDS | 0.789 | 1161 |
| IL-21_5618 | V98E, R115D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRDQKHRLECP SCDSYEKKPPKEFLERFKSLLQKMIHQHLSSRTHGSEDS | 0.79 | 1162 |
| IL-21_5258 | K81D, P107V, T110D, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSDNAGRRQKHRLECP SCDSYEKKPPKEFLERFKSLLQKMIHQHLSSRTHGSEDS | 0.791 | 1163 |
| IL-21_5106 | V98E, T110D, R115G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGRGQKHTLTCP SCDSYEKKPPKEFLERFKSLLQKMIHQHLSSRTHGSEDS | 0.792 | 1164 |
| IL-21_5269 | K81D, V98E, R115G, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGRGQKHRLECP SCDSYEKKPPKEFLERFKSLLQKMIHQHLSSRTHGSEDS | 0.793 | 1165 |
| IL-21_5457 | N70G, K81D, H118D, T121E | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGRRQKDRLECP SCDSYEKKPPKEFLERFKSLLQKMIHQHLSSRTHGSEDS | 0.793 | 1166 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5445 | N70G, V98E, T110D, R114Q | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSDNAGQRQKHRLTCP SCDSYEKKPPKEFLERFKSLLQKMIHQHLSSRTHGSEDS | 0.793 | 1167 |
| IL-21_5173 | K81D, R114G, R115G, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGGGQKHTLTCP SCDSYEKKPPKEFLERFKSLLQKMIHQHLSSRTHGSEDS | 0.793 | 1168 |
| IL-21_5222 | K81D, T110D, R114Q, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGQRQKDRLTCP SCDSYEKKPPKEFLERFKSLLQKMIHQHLSSRTHGSEDS | 0.793 | 1169 |
| IL-21_5287 | K81D, V98E, A112P, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNPGRRQKDRLTCP SCDSYEKKPPKEFLERFKSLLQKMIHQHLSSRTHGSEDS | 0.794 | 1170 |
| IL-21_5893 | I45T, K81D, R114Q, R115D | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKPPSTNAGQDQKHRLTCP SCDSYEKKPPKEFLERFKSLLQKMIHQHLSSRTHGSEDS | 0.797 | 1171 |
| IL-21_5277 | K81D, V98E, R114G, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGGRQKDRLTCP SCDSYEKKPPKEFLERFKSLLQKMIHQHLSSRTHGSEDS | 0.797 | 1172 |
| IL-21_5151 | V98E, P107V, A112P, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNPGRDQKHRLTCP SCDSYEKKPPKEFLERFKSLLQKMIHQHLSSRTHGSEDS | 0.798 | 1173 |
| IL-21_6305 | H35F, V98E, R115D | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINESIKKLKRKPPSTNAGRDQKHRLTCP SCDSYEKKPPKEFLERFKSLLQKMIHQHLSSRTHGSEDS | 0.798 | 1174 |
| IL-21_5771 | N70G, K81D, V98E | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINESIKKLKRKPPSTNAGRRQKHRLTCP SCDSYEKKPPKEFLERFKSLLQKMIHQHLSSRTHGSEDS | 0.798 | 1175 |
| IL-21_5444 | N70G, V98E, T110D, R114G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSDNAGGRQKHRLTCP SCDSYEKKPPKEFLERFKSLLQKMIHQHLSSRTHGSEDS | 0.799 | 1176 |
| IL-21_5468 | N70G, K81D, R114G, R115G | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGGGQKHRLTCP SCDSYEKKPPKEFLERFKSLLQKMIHQHLSSRTHGSEDS | 0.799 | 1177 |
| IL-21_5063 | V98E, R115D, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRDQKDRLECP SCDSYEKKPPKEFLERFKSLLQKMIHQHLSSRTHGSEDS | 0.799 | 1178 |
| IL-21_5236 | K81D, P107V, R115G, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGRGQKHTLTCP SCDSYEKKPPKEFLERFKSLLQKMIHQHLSSRTHGSEDS | 0.799 | 1179 |
| IL-21_6087 | H35F, I45T, K81D, V98E | MRSSPGNMERIVICLMVIFLGTLVHKSSSQGQDRFMIRMRQ LIDTVDQLKNYVNDLVPEFLPAPEDVETNCEWSAFSCFQDA QLKSANTGNNERIINESIKKLKRKPPSTNAGRRQKHRLTCP SCDSYEKKPPKEFLERFKSLLQKMIHQHLSSRTHGSEDS | 0.799 | 1180 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5137 | V98E, P107V, R114G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGGRQKHRLECP SCDSYEKKPPKEFLERFKSLLQKMIHQHLSSRTHGSEDS | 0.799 | 1181 |
| IL-21_5891 | I45T, K81D, R114G, R115D | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKPPSTNAGGDQKHRLTCP SCDSYEKKPPKEFLERFKSLLQKMIHQHLSSRTHGSEDS | 0.799 | 1182 |
| IL-21_5112 | V98E, T110D, R114G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGGRQKHTLTCP SCDSYEKKPPKEFLERFKSLLQKMIHQHLSSRTHGSEDS | 0.801 | 1183 |
| IL-21_6145 | H35I, K81D, A112P, R115G | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSTNPGRGQKHRLTCP SCDSYEKKPPKEFLERFKSLLQKMIHQHLSSRTHGSEDS | 0.802 | 1184 |
| IL-21_5094 | V98E, A112P, R114G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGGRQKDRLTCP SCDSYEKKPPKEFLERFKSLLQKMIHQHLSSRTHGSEDS | 0.804 | 1185 |
| IL-21_5692 | K81D, P107V, R115G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGRGQKHRLTCP SCDSYEKKPPKEFLERFKSLLQKMIHQHLSSRTHGSEDS | 0.804 | 1186 |
| IL-21_5102 | V98E, T110D, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGRRQKHTLECP SCDSYEKKPPKEFLERFKSLLQKMIHQHLSSRTHGSEDS | 0.806 | 1187 |
| IL-21_5965 | H35F, P107V, R114Q, R115D | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKVPSTNAGQDQKHRLTCP SCDSYEKKPPKEFLERFKSLLQKMIHQHLSSRTHGSEDS | 0.807 | 1188 |
| IL-21_5461 | N70G, K81D, R115G, H118D | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGRGQKDRLTCP SCDSYEKKPPKEFLERFKSLLQKMIHQHLSSRTHGSEDS | 0.807 | 1189 |
| IL-21_5068 | V98E, R114G, R115G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGGGQKHRLECP SCDSYEKKPPKEFLERFKSLLQKMIHQHLSSRTHGSEDS | 0.807 | 1190 |
| IL-21_5085 | V98E, A112P, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGRRQKDTLTCP SCDSYEKKPPKEFLERFKSLLQKMIHQHLSSRTHGSEDS | 0.808 | 1191 |
| IL-21_5765 | N70G, K81D, R115D | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGRDQKHRLTCP SCDSYEKKPPKEFLERFKSLLQKMIHQHLSSRTHGSEDS | 0.808 | 1192 |
| IL-21_6040 | H35F, N70G, V98E, R115D | MRSSPGNMERIVICLMVIFLGTLVHKSSSQGQDREMIRMRQ LIDIVDQLKNYVNDLVPEFLPAPEDVETGCEWSAFSCFQKA QLKSANTGNNERIINESIKKLKRKPPSTNAGRDQKHRLTCP SCDSYEKKPPKEFLERFKSLLQKMIHQHLSSRTHGSEDS | 0.809 | 1193 |
| IL-21_6083 | H35F, I45T, K81D, R114Q | MRSSPGNMERIVICLMVIFLGTLVHKSSSQGQDRFMIRMRQ LIDTVDQLKNYVNDLVPEFLPAPEDVETNCEWSAFSCFQDA QLKSANTGNNERIINVSIKKLKRKPPSTNAGQRQKHRLTCP SCDSYEKKPPKEFLERFKSLLQKMIHQHLSSRTHGSEDS | 0.809 | 1194 |
| IL-21_5685 | K81D, T110D, R115D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGRDQKHRLTCP SCDSYEKKPPKEFLERFKSLLQKMIHQHLSSRTHGSEDS | 0.809 | 1195 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_6227 | H35I, I45T, K81D, R115D | MRSSPGNMERIVICLMVIFLGTLVHKSSSQGQDRIMIRMRQ LIDTVDQLKNYVNDLVPEFLPAPEDVETNCEWSAFSCFQDA QLKSANTGNNERIINVSIKKLKRKPPSTNAGRDQKHRLTCP SCDSYEKKPPKEFLERFKSLLQKMIHQHLSSRTHGSEDS | 0.81 | 1196 |
| IL-21_5176 | K81D, R114G, R115D, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGGDQKHTLTCP SCDSYEKKPPKEFLERFKSLLQKMIHQHLSSRTHGSEDS | 0.81 | 1197 |
| IL-21_5124 | V98E, T110D, A112P, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNPGRGQKHRLTCP SCDSYEKKPPKEFLERFKSLLQKMIHQHLSSRTHGSEDS | 0.81 | 1198 |
| IL-21_5205 | K81D, A112P, R114Q, R115D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGQDQKHRLTCP SCDSYEKKPPKEFLERFKSLLQKMIHQHLSSRTHGSEDS | 0.81 | 1199 |
| IL-21_5090 | V98E, A112P, R115D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGRDQKHTLTCP SCDSYEKKPPKEFLERFKSLLQKMIHQHLSSRTHGSEDS | 0.81 | 1200 |
| IL-21_5818 | V98E, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRDQKHRLTCP SCDSYEKKPPKEFLERFKSLLQKMIHQHLSSRTHGSEDS | 0.811 | 1201 |
| IL-21_5207 | K81D, T110D, H118D, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGRRQKDRLECP SCDSYEKKPPKEFLERFKSLLQKMIHQHLSSRTHGSEDS | 0.812 | 1202 |
| IL-21_5880 | I45T, V98E, T110D, R115D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKPPSDNAGRDQKHRLTCP SCDSYEKKPPKEFLERFKSLLQKMIHQHLSSRTHGSEDS | 0.815 | 1203 |
| IL-21_5138 | V98E, P107V, R114G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGGRQKHTLTCP SCDSYEKKPPKEFLERFKSLLQKMIHQHLSSRTHGSEDS | 0.815 | 1204 |
| IL-21_6188 | H35I, N70G, V98E, R114Q | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINESIKKLKRKPPSTNAGQRQKHRLTCP SCDSYEKKPPKEFLERFKSLLQKMIHQHLSSRTHGSEDS | 0.817 | 1205 |
| IL-21_6041 | H35F, N70G, V98E, R114G | MRSSPGNMERIVICLMVIFLGTLVHKSSSQGQDRFMIRMRQ LIDIVDQLKNYVNDLVPEFLPAPEDVETGCEWSAFSCFQKA QLKSANTGNNERIINESIKKLKRKPPSTNAGGRQKHRLTCP SCDSYEKKPPKEFLERFKSLLQKMIHQHLSSRTHGSEDS | 0.817 | 1206 |
| IL-21_5100 | V98E, A112P, R114Q, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGQGQKHRLTCP SCDSYEKKPPKEFLERFKSLLQKMIHQHLSSRTHGSEDS | 0.818 | 1207 |
| IL-21_5058 | V98E, H118D, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRRQKDTLECP SCDSYEKKPPKEFLERFKSLLQKMIHQHLSSRTHGSEDS | 0.818 | 1208 |
| IL-21_5232 | K81D, P107V, R119T, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGRRQKHTLECP SCDSYEKKPPKEFLERFKSLLQKMIHQHLSSRTHGSEDS | 0.819 | 1209 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5628 | V98E, R114Q, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGQRQKDRLTCP SCDSYEKKPPKEFLERFKSLLQKMIHQHLSSRTHGSEDS | 0.82 | 1210 |
| IL-21_6159 | H35I, K81D, P107V, T110D | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKVPSDNAGRRQKHRLTCP SCDSYEKKPPKEFLERFKSLLQKMIHQHLSSRTHGSEDS | 0.82 | 1211 |
| IL-21_5756 | N70G, V98E, R114G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGGRQKHRLTCP SCDSYEKKPPKEFLERFKSLLQKMIHQHLSSRTHGSEDS | 0.82 | 1212 |
| IL-21_5162 | K81D, H118D, R119T, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRRQKDTLECP SCDSYEKKPPKEFLERFKSLLQKMIHQHLSSRTHGSEDS | 0.82 | 1213 |
| IL-21_5957 | H35F, T110D, R114Q, R115D | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKPPSDNAGQDQKHRLTCP SCDSYEKKPPKEFLERFKSLLQKMIHQHLSSRTHGSEDS | 0.821 | 1214 |
| IL-21_5268 | K81D, V98E, H118D, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGRRQKDTLTCP SCDSYEKKPPKEFLERFKSLLQKMIHQHLSSRTHGSEDS | 0.821 | 1215 |
| IL-21_5210 | K81D, T110D, R115G, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGRGQKHTLTCP SCDSYEKKPPKEFLERFKSLLQKMIHQHLSSRTHGSEDS | 0.822 | 1216 |
| IL-21_5417 | N70G, V98E, R115G, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGRGQKHTLTCP SCDSYEKKPPKEFLERFKSLLQKMIHQHLSSRTHGSEDS | 0.822 | 1217 |
| IL-21_5662 | K81D, R115D, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRDQKHTLTCP SCDSYEKKPPKEFLERFKSLLQKMIHQHLSSRTHGSEDS | 0.822 | 1218 |
| IL-21_5065 | V98E, R114G, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGGRQKHTLECP SCDSYEKKPPKEFLERFKSLLQKMIHQHLSSRTHGSEDS | 0.823 | 1219 |
| IL-21_5650 | V98E, P107V, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGRDQKHRLTCP SCDSYEKKPPKEFLERFKSLLQKMIHQHLSSRTHGSEDS | 0.824 | 1220 |
| IL-21_5496 | N70G, K81D, P107V, R114Q | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKVPSTNAGQRQKHRLTCP SCDSYEKKPPKEFLERFKSLLQKMIHQHLSSRTHGSEDS | 0.825 | 1221 |
| IL-21_5661 | K81D, R115D, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRDQKHRLECP SCDSYEKKPPKEFLERFKSLLQKMIHQHLSSRTHGSEDS | 0.826 | 1222 |
| IL-21_6365 | H35I, K81D, R115D | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSTNAGRDQKHRLTCP SCDSYEKKPPKEFLERFKSLLQKMIHQHLSSRTHGSEDS | 0.829 | 1223 |
| IL-21_5266 | K81D, V98E, R119T, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGRRQKHTLECP SCDSYEKKPPKEFLERFKSLLQKMIHQHLSSRTHGSEDS | 0.83 | 1224 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5265 | K81D, P107V, T110D, A112P | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSDNPGRRQKHRLTCP SCDSYEKKPPKEFLERFKSLLQKMIHQHLSSRTHGSEDS | 0.83 | 1225 |
| IL-21_6128 | H35I, V98E, A112P, R114G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKPPSTNPGGRQKHRLTCP SCDSYEKKPPKEFLERFKSLLQKMIHQHLSSRTHGSEDS | 0.83 | 1226 |
| IL-21_5619 | V98E, R115D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRDQKHTLTCP SCDSYEKKPPKEFLERFKSLLQKMIHQHLSSRTHGSEDS | 0.831 | 1227 |
| IL-21_5492 | N70G, K81D, P107V, H118D | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKVPSTNAGRRQKDRLTCP SCDSYEKKPPKEFLERFKSLLQKMIHQHLSSRTHGSEDS | 0.831 | 1228 |
| IL-21_5218 | K81D, T110D, R114G, R115G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGGGQKHRLTCP SCDSYEKKPPKEFLERFKSLLQKMIHQHLSSRTHGSEDS | 0.832 | 1229 |
| IL-21_5061 | V98E, R115G, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRGQKDTLTCP SCDSYEKKPPKEFLERFKSLLQKMIHQHLSSRTHGSEDS | 0.832 | 1230 |
| IL-21_5660 | K81D, R115G, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRGQKDRLTCP SCDSYEKKPPKEFLERFKSLLQKMIHQHLSSRTHGSEDS | 0.833 | 1231 |
| IL-21_6313 | H35F, K81D, R114G | MRSSPGNMERIVICLMVIFLGTLVHKSSSQGQDREMIRMRQ LIDIVDQLKNYVNDLVPEFLPAPEDVETNCEWSAFSCFQDA QLKSANTGNNERIINVSIKKLKRKPPSTNAGGRQKHRLTCP SCDSYEKKPPKEFLERFKSLLQKMIHQHLSSRTHGSEDS | 0.833 | 1232 |
| IL-21_6193 | H35I, N70G, K81D, R115D | MRSSPGNMERIVICLMVIFLGTLVHKSSSQGQDRIMIRMRQ LIDIVDQLKNYVNDLVPEFLPAPEDVETGCEWSAFSCFQDA QLKSANTGNNERIINVSIKKLKRKPPSTNAGRDQKHRLTCP SCDSYEKKPPKEFLERFKSLLQKMIHQHLSSRTHGSEDS | 0.835 | 1233 |
| IL-21_6080 | H35F, I45T, K81D, R115G | MRSSPGNMERIVICLMVIFLGTLVHKSSSQGQDREMIRMRQ LIDTVDQLKNYVNDLVPEFLPAPEDVETNCEWSAFSCFQDA QLKSANTGNNERIINVSIKKLKRKPPSTNAGRGQKHRLTCP SCDSYEKKPPKEFLERFKSLLQKMIHQHLSSRTHGSEDS | 0.836 | 1234 |
| IL-21_5169 | K81D, R114G, R119T, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGGRQKHTLECP SCDSYEKKPPKEFLERFKSLLQKMIHQHLSSRTHGSEDS | 0.836 | 1235 |
| IL-21_5434 | N70G, V98E, A112P, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNPGRRQKDRLTCP SCDSYEKKPPKEFLERFKSLLQKMIHQHLSSRTHGSEDS | 0.837 | 1236 |
| IL-21_5371 | N70G, T110D, R114Q, R115D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGQDQKHRLTCP SCDSYEKKPPKEFLERFKSLLQKMIHQHLSSRTHGSEDS | 0.837 | 1237 |
| IL-21_5458 | N70G, K81D, H118D, R119T | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGRRQKDTLTCP SCDSYEKKPPKEFLERFKSLLQKMIHQHLSSRTHGSEDS | 0.837 | 1238 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5700 | K81D, V98E, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGRRQKDRLTCP SCDSYEKKPPKEFLERFKSLLQKMIHQHLSSRTHGSEDS | 0.837 | 1239 |
| IL-21_6050 | H35F, N70G, K81D, A112P | MRSSPGNMERIVICLMVIFLGTLVHKSSSQGQDRFMIRMRQ LIDIVDQLKNYVNDLVPEFLPAPEDVETGCEWSAFSCFQDA QLKSANTGNNERIINVSIKKLKRKPPSTNPGRRQKHRLTCP SCDSYEKKPPKEFLERFKSLLQKMIHQHLSSRTHGSEDS | 0.838 | 1240 |
| IL-21_5111 | V98E, T110D, R114G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGGRQKHRLECP SCDSYEKKPPKEFLERFKSLLQKMIHQHLSSRTHGSEDS | 0.838 | 1241 |
| IL-21_5698 | K81D, V98E, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGRRQKHRLECP SCDSYEKKPPKEFLERFKSLLQKMIHQHLSSRTHGSEDS | 0.839 | 1242 |
| IL-21_6052 | H35F, N70G, K81D, P107V | MRSSPGNMERIVICLMVIFLGTLVHKSSSQGQDRFMIRMRQ LIDIVDQLKNYVNDLVPEFLPAPEDVETGCEWSAFSCFQDA QLKSANTGNNERIINVSIKKLKRKVPSTNAGRRQKHRLTCP SCDSYEKKPPKEFLERFKSLLQKMIHQHLSSRTHGSEDS | 0.84 | 1243 |
| IL-21_5089 | V98E, A112P, R115D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGRDQKHRLECP SCDSYEKKPPKEFLERFKSLLQKMIHQHLSSRTHGSEDS | 0.84 | 1244 |
| IL-21_5174 | K81D, R114G, R115G, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGGGQKDRLTCP SCDSYEKKPPKEFLERFKSLLQKMIHQHLSSRTHGSEDS | 0.84 | 1245 |
| IL-21_5366 | N70G, T110D, R114G, R115D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGGDQKHRLTCP SCDSYEKKPPKEFLERFKSLLQKMIHQHLSSRTHGSEDS | 0.842 | 1246 |
| IL-21_5479 | N70G, K81D, A112P, R115D | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNPGRDQKHRLTCP SCDSYEKKPPKEFLERFKSLLQKMIHQHLSSRTHGSEDS | 0.842 | 1247 |
| IL-21_5874 | I45T, V98E, R114Q, R115D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKPPSTNAGQDQKHRLTCP SCDSYEKKPPKEFLERFKSLLQKMIHQHLSSRTHGSEDS | 0.843 | 1248 |
| IL-21_6157 | H35I, K81D, P107V, R114Q | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKVPSTNAGQRQKHRLTCP SCDSYEKKPPKEFLERFKSLLQKMIHQHLSSRTHGSEDS | 0.843 | 1249 |
| IL-21_6039 | H35F, N70G, V98E, R115G | MRSSPGNMERIVICLMVIFLGTLVHKSSSQGQDREMIRMRQ LIDIVDQLKNYVNDLVPEFLPAPEDVETGCEWSAFSCFQKA QLKSANTGNNERIINESIKKLKRKPPSTNAGRGQKHRLTCP SCDSYEKKPPKEFLERFKSLLQKMIHQHLSSRTHGSEDS | 0.844 | 1250 |
| IL-21_5450 | N70G, V98E, P107V, R115G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKVPSTNAGRGQKHRLTCP SCDSYEKKPPKEFLERFKSLLQKMIHQHLSSRTHGSEDS | 0.845 | 1251 |
| IL-21_5198 | K81D, A112P, R114G, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGGRQKDRLTCP SCDSYEKKPPKEFLERFKSLLQKMIHQHLSSRTHGSEDS | 0.847 | 1252 |
| IL-21_5828 | K81D, R115D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRDQKHRLTCP SCDSYEKKPPKEFLERFKSLLQKMIHQHLSSRTHGSEDS | 0.847 | 1253 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5293 | K81D, V98E, T110D, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSDNAGRRQKHTLTCP SCDSYEKKPPKEFLERFKSLLQKMIHQHLSSRTHGSEDS | 0.849 | 1254 |
| IL-21_5276 | K81D, V98E, R114G, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNAGGRQKHTLTCP SCDSYEKKPPKEFLERFKSLLQKMIHQHLSSRTHGSEDS | 0.849 | 1255 |
| IL-21_5220 | K81D, T110D, R114Q, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGQRQKHRLECP SCDSYEKKPPKEFLERFKSLLQKMIHQHLSSRTHGSEDS | 0.85 | 1256 |
| IL-21_6152 | H35I, K81D, T110D, R114Q | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSDNAGQRQKHRLTCP SCDSYEKKPPKEFLERFKSLLQKMIHQHLSSRTHGSEDS | 0.85 | 1257 |
| IL-21_6141 | H35I, K81D, R114G, R115G | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSTNAGGGQKHRLTCP SCDSYEKKPPKEFLERFKSLLQKMIHQHLSSRTHGSEDS | 0.851 | 1258 |
| IL-21_6012 | H35F, K81D, P107V, T110D | MRSSPGNMERIVICLMVIFLGTLVHKSSSQGQDRFMIRMRQ LIDIVDQLKNYVNDLVPEFLPAPEDVETNCEWSAFSCFQDA QLKSANTGNNERIINVSIKKLKRKVPSDNAGRRQKHRLTCP SCDSYEKKPPKEFLERFKSLLQKMIHQHLSSRTHGSEDS | 0.852 | 1259 |
| IL-21_5215 | K81D, T110D, R114G, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGGRQKHRLECP SCDSYEKKPPKEFLERFKSLLQKMIHQHLSSRTHGSEDS | 0.853 | 1260 |
| IL-21_5285 | K81D, V98E, A112P, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNPGRRQKHRLECP SCDSYEKKPPKEFLERFKSLLQKMIHQHLSSRTHGSEDS | 0.853 | 1261 |
| IL-21_5955 | H35F, T110D, R114G, R115D | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKPPSDNAGGDQKHRLTCP SCDSYEKKPPKEFLERFKSLLQKMIHQHLSSRTHGSEDS | 0.854 | 1262 |
| IL-21_5640 | V98E, T110D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGRRQKDRLTCP SCDSYEKKPPKEFLERFKSLLQKMIHQHLSSRTHGSEDS | 0.855 | 1263 |
| IL-21_5898 | I45T, K81D, T110D, R115G | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKPPSDNAGRGQKHRLTCP SCDSYEKKPPKEFLERFKSLLQKMIHQHLSSRTHGSEDS | 0.856 | 1264 |
| IL-21_5286 | K81D, V98E, A112P, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNPGRRQKHTLTCP SCDSYEKKPPKEFLERFKSLLQKMIHQHLSSRTHGSEDS | 0.857 | 1265 |
| IL-21_5484 | N70G, K81D, T110D, H118D | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSDNAGRRQKDRLTCP SCDSYEKKPPKEFLERFKSLLQKMIHQHLSSRTHGSEDS | 0.858 | 1266 |
| IL-21_5168 | K81D, R115D, H118D, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRDQKDTLTCP SCDSYEKKPPKEFLERFKSLLQKMIHQHLSSRTHGSEDS | 0.859 | 1267 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_6149 | H35I, K81D, T110D, R115G | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSDNAGRGQKHRLTCP SCDSYEKKPPKEFLERFKSLLQKMIHQHLSSRTHGSEDS | 0.859 | 1268 |
| IL-21_6042 | H35F, N70G, V98E, R114Q | MRSSPGNMERIVICLMVIFLGTLVHKSSSQGQDRFMIRMRQ LIDIVDQLKNYVNDLVPEFLPAPEDVETGCEWSAFSCFQKA QLKSANTGNNERIINESIKKLKRKPPSTNAGQRQKHRLTCP SCDSYEKKPPKEFLERFKSLLQKMIHQHLSSRTHGSEDS | 0.86 | 1269 |
| IL-21_6316 | H35F, K81D, T110D | MRSSPGNMERIVICLMVIFLGTLVHKSSSQGQDREMIRMRQ LIDIVDQLKNYVNDLVPEFLPAPEDVETNCEWSAFSCFQDA QLKSANTGNNERIINVSIKKLKRKPPSDNAGRRQKHRLTCP SCDSYEKKPPKEFLERFKSLLQKMIHQHLSSRTHGSEDS | 0.86 | 1270 |
| IL-21_6228 | H35I, I45T, K81D, R114G | MRSSPGNMERIVICLMVIFLGTLVHKSSSQGQDRIMIRMRQ LIDTVDQLKNYVNDLVPEFLPAPEDVETNCEWSAFSCFQDA QLKSANTGNNERIINVSIKKLKRKPPSTNAGGRQKHRLTCP SCDSYEKKPPKEFLERFKSLLQKMIHQHLSSRTHGSEDS | 0.862 | 1271 |
| IL-21_5460 | N70G, K81D, R115G, R119T | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGRGQKHTLTCP SCDSYEKKPPKEFLERFKSLLQKMIHQHLSSRTHGSEDS | 0.862 | 1272 |
| IL-21_5643 | V98E, T110D, R114G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGGRQKHRLTCP SCDSYEKKPPKEFLERFKSLLQKMIHQHLSSRTHGSEDS | 0.862 | 1273 |
| IL-21_5975 | H35F, V98E, R114G, R115G | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINESIKKLKRKPPSTNAGGGQKHRLTCP SCDSYEKKPPKEFLERFKSLLQKMIHQHLSSRTHGSEDS | 0.863 | 1274 |
| IL-21_5633 | V98E, A112P, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGRRQKDRLTCP SCDSYEKKPPKEFLERFKSLLQKMIHQHLSSRTHGSEDS | 0.863 | 1275 |
| IL-21_5624 | V98E, R114G, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGGGQKHRLTCP SCDSYEKKPPKEFLERFKSLLQKMIHQHLSSRTHGSEDS | 0.864 | 1276 |
| IL-21_5246 | K81D, P107V, R114Q, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGQRQKHRLECP SCDSYEKKPPKEFLERFKSLLQKMIHQHLSSRTHGSEDS | 0.865 | 1277 |
| IL-21_5012 | P107V, R114Q, R115D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGQDQKDRLTCP SCDSYEKKPPKEFLERFKSLLQKMIHQHLSSRTHGSEDS | 0.865 | 1278 |
| IL-21_5423 | N70G, V98E, R114G, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGGRQKHTLTCP SCDSYEKKPPKEFLERFKSLLQKMIHQHLSSRTHGSEDS | 0.865 | 1279 |
| IL-21_5672 | K81D, R114Q, R115G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGQGQKHRLTCP SCDSYEKKPPKEFLERFKSLLQKMIHQHLSSRTHGSEDS | 0.865 | 1280 |
| IL-21_5228 | K81D, T110D, A112P, R115G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNPGRGQKHRLTCP SCDSYEKKPPKEFLERFKSLLQKMIHQHLSSRTHGSEDS | 0.866 | 1281 |
| IL-21_5247 | K81D, P107V, R114Q, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGQRQKHTLTCP SCDSYEKKPPKEFLERFKSLLQKMIHQHLSSRTHGSEDS | 0.866 | 1282 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5488 | N70G, K81D, T110D, R114Q | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSDNAGQRQKHRLTCP SCDSYEKKPPKEFLERFKSLLQKMIHQHLSSRTHGSEDS | 0.867 | 1283 |
| IL-21_5989 | H35F, V98E, P107V, R115D | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINESIKKLKRKVPSTNAGRDQKHRLTCP SCDSYEKKPPKEFLERFKSLLQKMIHQHLSSRTHGSEDS | 0.868 | 1284 |
| IL-21_5478 | N70G, K81D, A112P, R115G | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNPGRGQKHRLTCP SCDSYEKKPPKEFLERFKSLLQKMIHQHLSSRTHGSEDS | 0.869 | 1285 |
| IL-21_5235 | K81D, P107V, R115G, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGRGQKHRLECP SCDSYEKKPPKEFLERFKSLLQKMIHQHLSSRTHGSEDS | 0.87 | 1286 |
| IL-21_5439 | N70G, V98E, T110D, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSDNAGRRQKHRLECP SCDSYEKKPPKEFLERFKSLLQKMIHQHLSSRTHGSEDS | 0.87 | 1287 |
| IL-21_5641 | V98E, T110D, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGRGQKHRLTCP SCDSYEKKPPKEFLERFKSLLQKMIHQHLSSRTHGSEDS | 0.871 | 1288 |
| IL-21_5465 | N70G, K81D, R114G, T121E | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGGRQKHRLECP SCDSYEKKPPKEFLERFKSLLQKMIHQHLSSRTHGSEDS | 0.871 | 1289 |
| IL-21_5963 | H35F, P107V, R114G, R115D | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKVPSTNAGGDQKHRLTCP SCDSYEKKPPKEFLERFKSLLQKMIHQHLSSRTHGSEDS | 0.872 | 1290 |
| IL-21_5324 | N70G, R114G, R115D, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGGDQKDRLTCP SCDSYEKKPPKEFLERFKSLLQKMIHQHLSSRTHGSEDS | 0.872 | 1291 |
| IL-21_5227 | K81D, T110D, A112P, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNPGRRQKDRLTCP SCDSYEKKPPKEFLERFKSLLQKMIHQHLSSRTHGSEDS | 0.873 | 1292 |
| IL-21_5197 | K81D, A112P, R114G, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGGRQKHTLTCP SCDSYEKKPPKEFLERFKSLLQKMIHQHLSSRTHGSEDS | 0.873 | 1293 |
| IL-21_5663 | K81D, R115D, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRDQKDRLTCP SCDSYEKKPPKEFLERFKSLLQKMIHQHLSSRTHGSEDS | 0.873 | 1294 |
| IL-21_6198 | H35I, N70G, K81D, P107V | MRSSPGNMERIVICLMVIFLGTLVHKSSSQGQDRIMIRMRQ LIDIVDQLKNYVNDLVPEFLPAPEDVETGCEWSAFSCFQDA QLKSANTGNNERIINVSIKKLKRKVPSTNAGRRQKHRLTCP SCDSYEKKPPKEFLERFKSLLQKMIHQHLSSRTHGSEDS | 0.874 | 1295 |
| IL-21_6122 | H35I, V98E, R114G, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKPPSTNAGGGQKHRLTCP SCDSYEKKPPKEFLERFKSLLQKMIHQHLSSRTHGSEDS | 0.875 | 1296 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_6357 | H35I, V98E, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKPPSTNAGRGQKHRLTCP SCDSYEKKPPKEFLERFKSLLQKMIHQHLSSRTHGSEDS | 0.875 | 1297 |
| IL-21_6129 | H35I, V98E, A112P, R114Q | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKPPSTNPGQRQKHRLTCP SCDSYEKKPPKEFLERFKSLLQKMIHQHLSSRTHGSEDS | 0.876 | 1298 |
| IL-21_5428 | N70G, V98E, R114Q, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGQRQKHTLTCP SCDSYEKKPPKEFLERFKSLLQKMIHQHLSSRTHGSEDS | 0.877 | 1299 |
| IL-21_5620 | V98E, R115D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRDQKDRLTCP SCDSYEKKPPKEFLERFKSLLQKMIHQHLSSRTHGSEDS | 0.877 | 1300 |
| IL-21_5091 | V98E, A112P, R115D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGRDQKDRLTCP SCDSYEKKPPKEFLERFKSLLQKMIHQHLSSRTHGSEDS | 0.879 | 1301 |
| IL-21_5427 | N70G, V98E, R114Q, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGQRQKHRLECP SCDSYEKKPPKEFLERFKSLLQKMIHQHLSSRTHGSEDS | 0.879 | 1302 |
| IL-21_5160 | V98E, P107V, T110D, R114Q | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSDNAGQRQKHRLTCP SCDSYEKKPPKEFLERFKSLLQKMIHQHLSSRTHGSEDS | 0.879 | 1303 |
| IL-21_5116 | V98E, T110D, R114Q, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGQRQKHRLECP SCDSYEKKPPKEFLERFKSLLQKMIHQHLSSRTHGSEDS | 0.879 | 1304 |
| IL-21_6314 | H35F, K81D, R114Q | MRSSPGNMERIVICLMVIFLGTLVHKSSSQGQDREMIRMRQ LIDIVDQLKNYVNDLVPEFLPAPEDVETNCEWSAFSCFQDA QLKSANTGNNERIINVSIKKLKRKPPSTNAGQRQKHRLTCP SCDSYEKKPPKEFLERFKSLLQKMIHQHLSSRTHGSEDS | 0.88 | 1305 |
| IL-21_5127 | V98E, T110D, A112P, R114Q | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNPGQRQKHRLTCP SCDSYEKKPPKEFLERFKSLLQKMIHQHLSSRTHGSEDS | 0.881 | 1306 |
| IL-21_5084 | V98E, A112P, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGRRQKDRLECP SCDSYEKKPPKEFLERFKSLLQKMIHQHLSSRTHGSEDS | 0.881 | 1307 |
| IL-21_6147 | H35I, K81D, A112P, R114G | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSTNPGGRQKHRLTCP SCDSYEKKPPKEFLERFKSLLQKMIHQHLSSRTHGSEDS | 0.882 | 1308 |
| IL-21_5490 | N70G, K81D, P107V, T121E | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKVPSTNAGRRQKHRLECP SCDSYEKKPPKEFLERFKSLLQKMIHQHLSSRTHGSEDS | 0.882 | 1309 |
| IL-21_6150 | H35I, K81D, T110D, R115D | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSDNAGRDQKHRLTCP SCDSYEKKPPKEFLERFKSLLQKMIHQHLSSRTHGSEDS | 0.882 | 1310 |
| IL-21_5206 | K81D, T110D, R119T, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGRRQKHTLECP SCDSYEKKPPKEFLERFKSLLQKMIHQHLSSRTHGSEDS | 0.884 | 1311 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5629 | V98E, R114Q, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGQGQKHRLTCP SCDSYEKKPPKEFLERFKSLLQKMIHQHLSSRTHGSEDS | 0.884 | 1312 |
| IL-21_5165 | K81D, R115G, H118D, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRGQKDTLTCP SCDSYEKKPPKEFLERFKSLLQKMIHQHLSSRTHGSEDS | 0.884 | 1313 |
| IL-21_5971 | H35F, P107V, T110D, R115D | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKVPSDNAGRDQKHRLTCP SCDSYEKKPPKEFLERFKSLLQKMIHQHLSSRTHGSEDS | 0.885 | 1314 |
| IL-21_6049 | H35F, N70G, K81D, R114Q | MRSSPGNMERIVICLMVIFLGTLVHKSSSQGQDREMIRMRQ LIDIVDQLKNYVNDLVPEFLPAPEDVETGCEWSAFSCFQDA QLKSANTGNNERIINVSIKKLKRKPPSTNAGQRQKHRLTCP SCDSYEKKPPKEFLERFKSLLQKMIHQHLSSRTHGSEDS | 0.888 | 1315 |
| IL-21_6044 | H35F, N70G, V98E, T110D | MRSSPGNMERIVICLMVIFLGTLVHKSSSQGQDREMIRMRQ LIDIVDQLKNYVNDLVPEFLPAPEDVETGCEWSAFSCFQKA QLKSANTGNNERIINESIKKLKRKPPSDNAGRRQKHRLTCP SCDSYEKKPPKEFLERFKSLLQKMIHQHLSSRTHGSEDS | 0.888 | 1316 |
| IL-21_5900 | I45T, K81D, T110D, R114G | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKPPSDNAGGRQKHRLTCP SCDSYEKKPPKEFLERFKSLLQKMIHQHLSSRTHGSEDS | 0.888 | 1317 |
| IL-21_5392 | N70G, P107V, R114G, R115D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGGDQKHRLTCP SCDSYEKKPPKEFLERFKSLLQKMIHQHLSSRTHGSEDS | 0.888 | 1318 |
| IL-21_6146 | H35I, K81D, A112P, R115D | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSTNPGRDQKHRLTCP SCDSYEKKPPKEFLERFKSLLQKMIHQHLSSRTHGSEDS | 0.89 | 1319 |
| IL-21_5154 | V98E, P107V, T110D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSDNAGRRQKHRLECP SCDSYEKKPPKEFLERFKSLLQKMIHQHLSSRTHGSEDS | 0.89 | 1320 |
| IL-21_5767 | N70G, K81D, R114Q | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGQRQKHRLTCP SCDSYEKKPPKEFLERFKSLLQKMIHQHLSSRTHGSEDS | 0.89 | 1321 |
| IL-21_5191 | K81D, A112P, R115G, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGRGQKHTLTCP SCDSYEKKPPKEFLERFKSLLQKMIHQHLSSRTHGSEDS | 0.89 | 1322 |
| IL-21_5059 | V98E, R115G, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRGQKHTLECP SCDSYEKKPPKEFLERFKSLLQKMIHQHLSSRTHGSEDS | 0.893 | 1323 |
| IL-21_5193 | K81D, A112P, R115D, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGRDQKHRLECP SCDSYEKKPPKEFLERFKSLLQKMIHQHLSSRTHGSEDS | 0.894 | 1324 |
| IL-21_5416 | N70G, V98E, R115G, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGRGQKHRLECP SCDSYEKKPPKEFLERFKSLLQKMIHQHLSSRTHGSEDS | 0.894 | 1325 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_6367 | H35I, K81D, R114Q | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSTNAGQRQKHRLTCP SCDSYEKKPPKEFLERFKSLLQKMIHQHLSSRTHGSEDS | 0.894 | 1326 |
| IL-21_5659 | K81D, R115G, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRGQKHTLTCP SCDSYEKKPPKEFLERFKSLLQKMIHQHLSSRTHGSEDS | 0.895 | 1327 |
| IL-21_5914 | I45T, K81D, V98E, T110D | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINESIKKLKRKPPSDNAGRRQKHRLTCP SCDSYEKKPPKEFLERFKSLLQKMIHQHLSSRTHGSEDS | 0.896 | 1328 |
| IL-21_5453 | N70G, V98E, P107V, R114Q | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKVPSTNAGQRQKHRLTCP SCDSYEKKPPKEFLERFKSLLQKMIHQHLSSRTHGSEDS | 0.896 | 1329 |
| IL-21_5095 | V98E, A112P, R114G, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGGGQKHRLTCP SCDSYEKKPPKEFLERFKSLLQKMIHQHLSSRTHGSEDS | 0.897 | 1330 |
| IL-21_5190 | K81D, A112P, R115G, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGRGQKHRLECP SCDSYEKKPPKEFLERFKSLLQKMIHQHLSSRTHGSEDS | 0.898 | 1331 |
| IL-21_5071 | V98E, R114G, R115D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGGDQKHRLECP SCDSYEKKPPKEFLERFKSLLQKMIHQHLSSRTHGSEDS | 0.901 | 1332 |
| IL-21_5254 | K81D, P107V, A112P, R115G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNPGRGQKHRLTCP SCDSYEKKPPKEFLERFKSLLQKMIHQHLSSRTHGSEDS | 0.901 | 1333 |
| IL-21_5231 | K81D, T110D, A112P, R114Q | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNPGQRQKHRLTCP SCDSYEKKPPKEFLERFKSLLQKMIHQHLSSRTHGSEDS | 0.901 | 1334 |
| IL-21_5953 | H35F, A112P, R114Q, R115D | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKPPSTNPGQDQKHRLTCP SCDSYEKKPPKEFLERFKSLLQKMIHQHLSSRTHGSEDS | 0.901 | 1335 |
| IL-21_5697 | K81D, P107V, T110D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSDNAGRRQKHRLTCP SCDSYEKKPPKEFLERFKSLLQKMIHQHLSSRTHGSEDS | 0.901 | 1336 |
| IL-21_5241 | K81D, P107V, R114G, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGGRQKHRLECP SCDSYEKKPPKEFLERFKSLLQKMIHQHLSSRTHGSEDS | 0.902 | 1337 |
| IL-21_6226 | H35I, I45T, K81D, R115G | MRSSPGNMERIVICLMVIFLGTLVHKSSSQGQDRIMIRMRQ LIDTVDQLKNYVNDLVPEFLPAPEDVETNCEWSAFSCFQDA QLKSANTGNNERIINVSIKKLKRKPPSTNAGRGQKHRLTCP SCDSYEKKPPKEFLERFKSLLQKMIHQHLSSRTHGSEDS | 0.902 | 1338 |
| IL-21_6143 | H35I, K81D, R114Q, R115G | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSTNAGQGQKHRLTCP SCDSYEKKPPKEFLERFKSLLQKMIHQHLSSRTHGSEDS | 0.903 | 1339 |
| IL-21_5131 | V98E, P107V, R115G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGRGQKHRLECP SCDSYEKKPPKEFLERFKSLLQKMIHQHLSSRTHGSEDS | 0.903 | 1340 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5199 | K81D, A112P, R114G, R115G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGGGQKHRLTCP SCDSYEKKPPKEFLERFKSLLQKMIHQHLSSRTHGSEDS | 0.904 | 1341 |
| IL-21_5230 | K81D, T110D, A112P, R114G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNPGGRQKHRLTCP SCDSYEKKPPKEFLERFKSLLQKMIHQHLSSRTHGSEDS | 0.904 | 1342 |
| IL-21_6195 | H35I, N70G, K81D, R114Q | MRSSPGNMERIVICLMVIFLGTLVHKSSSQGQDRIMIRMRQ LIDIVDQLKNYVNDLVPEFLPAPEDVETGCEWSAFSCFQDA QLKSANTGNNERIINVSIKKLKRKPPSTNAGQRQKHRLTCP SCDSYEKKPPKEFLERFKSLLQKMIHQHLSSRTHGSEDS | 0.904 | 1343 |
| IL-21_5075 | V98E, R114Q, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGQRQKDRLECP SCDSYEKKPPKEFLERFKSLLQKMIHQHLSSRTHGSEDS | 0.904 | 1344 |
| IL-21_5954 | H35F, T110D, R114G, R115G | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKPPSDNAGGGQKHRLTCP SCDSYEKKPPKEFLERFKSLLQKMIHQHLSSRTHGSEDS | 0.905 | 1345 |
| IL-21_5333 | N70G, R114Q, R115D, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGQDQKDRLTCP SCDSYEKKPPKEFLERFKSLLQKMIHQHLSSRTHGSEDS | 0.907 | 1346 |
| IL-21_5657 | K81D, H118D, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRRQKDTLTCP SCDSYEKKPPKEFLERFKSLLQKMIHQHLSSRTHGSEDS | 0.907 | 1347 |
| IL-21_6359 | H35I, V98E, R114G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKPPSTNAGGRQKHRLTCP SCDSYEKKPPKEFLERFKSLLQKMIHQHLSSRTHGSEDS | 0.908 | 1348 |
| IL-21_5045 | P107V, T110D, R114G, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGGDQKHRLTCP SCDSYEKKPPKEFLERFKSLLQKMIHQHLSSRTHGSEDS | 0.908 | 1349 |
| IL-21_5649 | V98E, P107V, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGRGQKHRLTCP SCDSYEKKPPKEFLERFKSLLQKMIHQHLSSRTHGSEDS | 0.91 | 1350 |
| IL-21_6306 | H35F, V98E, R114G | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINESIKKLKRKPPSTNAGGRQKHRLTCP SCDSYEKKPPKEFLERFKSLLQKMIHQHLSSRTHGSEDS | 0.91 | 1351 |
| IL-21_5481 | N70G, K81D, A112P, R114Q | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNPGQRQKHRLTCP SCDSYEKKPPKEFLERFKSLLQKMIHQHLSSRTHGSEDS | 0.912 | 1352 |
| IL-21_5981 | H35F, V98E, A112P, R114G | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINESIKKLKRKPPSTNPGGRQKHRLTCP SCDSYEKKPPKEFLERFKSLLQKMIHQHLSSRTHGSEDS | 0.912 | 1353 |
| IL-21_5449 | N70G, V98E, P107V, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKVPSTNAGRRQKDRLTCP SCDSYEKKPPKEFLERFKSLLQKMIHQHLSSRTHGSEDS | 0.913 | 1354 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5936 | I45T, N70G, V98E, R115D | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINESIKKLKRKPPSTNAGRDQKHRLTCP SCDSYEKKPPKEFLERFKSLLQKMIHQHLSSRTHGSEDS | 0.914 | 1355 |
| IL-21_5656 | K81D, H118D, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRRQKDRLECP SCDSYEKKPPKEFLERFKSLLQKMIHQHLSSRTHGSEDS | 0.914 | 1356 |
| IL-21_4949 | T110D, R115D, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRDQKDRLECP SCDSYEKKPPKEFLERFKSLLQKMIHQHLSSRTHGSEDS | 0.915 | 1357 |
| IL-21_5694 | K81D, P107V, R114G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGGRQKHRLTCP SCDSYEKKPPKEFLERFKSLLQKMIHQHLSSRTHGSEDS | 0.916 | 1358 |
| IL-21_5482 | N70G, K81D, T110D, T121E | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSDNAGRRQKHRLECP SCDSYEKKPPKEFLERFKSLLQKMIHQHLSSRTHGSEDS | 0.916 | 1359 |
| IL-21_5437 | N70G, V98E, A112P, R114G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNPGGRQKHRLTCP SCDSYEKKPPKEFLERFKSLLQKMIHQHLSSRTHGSEDS | 0.916 | 1360 |
| IL-21_4993 | P107V, R115D, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGRDQKDRLECP SCDSYEKKPPKEFLERFKSLLQKMIHQHLSSRTHGSEDS | 0.917 | 1361 |
| IL-21_5669 | K81D, R114Q, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGQRQKHRLECP SCDSYEKKPPKEFLERFKSLLQKMIHQHLSSRTHGSEDS | 0.917 | 1362 |
| IL-21_5678 | K81D, A112P, R115D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGRDQKHRLTCP SCDSYEKKPPKEFLERFKSLLQKMIHQHLSSRTHGSEDS | 0.918 | 1363 |
| IL-21_6140 | H35I, V98E, P107V, T110D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKVPSDNAGRRQKHRLTCP SCDSYEKKPPKEFLERFKSLLQKMIHQHLSSRTHGSEDS | 0.918 | 1364 |
| IL-21_5087 | V98E, A112P, R115G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGRGQKHTLTCP SCDSYEKKPPKEFLERFKSLLQKMIHQHLSSRTHGSEDS | 0.919 | 1365 |
| IL-21_5985 | H35F, V98E, T110D, R114G | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINESIKKLKRKPPSDNAGGRQKHRLTCP SCDSYEKKPPKEFLERFKSLLQKMIHQHLSSRTHGSEDS | 0.919 | 1366 |
| IL-21_5452 | N70G, V98E, P107V, R114G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKVPSTNAGGRQKHRLTCP SCDSYEKKPPKEFLERFKSLLQKMIHQHLSSRTHGSEDS | 0.919 | 1367 |
| IL-21_5438 | N70G, V98E, A112P, R114Q | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNPGQRQKHRLTCP SCDSYEKKPPKEFLERFKSLLQKMIHQHLSSRTHGSEDS | 0.919 | 1368 |
| IL-21_5991 | H35F, V98E, P107V, R114Q | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINESIKKLKRKVPSTNAGQRQKHRLTCP SCDSYEKKPPKEFLERFKSLLQKMIHQHLSSRTHGSEDS | 0.92 | 1369 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5915 | I45T, K81D, V98E, P107V | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINESIKKLKRKVPSTNAGRRQKHRLTCP SCDSYEKKPPKEFLERFKSLLQKMIHQHLSSRTHGSEDS | 0.92 | 1370 |
| IL-21_5128 | V98E, P107V, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGRRQKHTLECP SCDSYEKKPPKEFLERFKSLLQKMIHQHLSSRTHGSEDS | 0.921 | 1371 |
| IL-21_4994 | P107V, R115D, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGRDQKDTLTCP SCDSYEKKPPKEFLERFKSLLQKMIHQHLSSRTHGSEDS | 0.921 | 1372 |
| IL-21_5459 | N70G, K81D, R115G, T121E | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGRGQKHRLECP SCDSYEKKPPKEFLERFKSLLQKMIHQHLSSRTHGSEDS | 0.921 | 1373 |
| IL-21_5315 | N70G, R115D, H118D, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRDQKDTLTCP SCDSYEKKPPKEFLERFKSLLQKMIHQHLSSRTHGSEDS | 0.921 | 1374 |
| IL-21_6307 | H35F, V98E, R114Q | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINESIKKLKRKPPSTNAGQRQKHRLTCP SCDSYEKKPPKEFLERFKSLLQKMIHQHLSSRTHGSEDS | 0.922 | 1375 |
| IL-21_6153 | H35I, K81D, T110D, A112P | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSDNPGRRQKHRLTCP SCDSYEKKPPKEFLERFKSLLQKMIHQHLSSRTHGSEDS | 0.922 | 1376 |
| IL-21_5759 | N70G, V98E, T110D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSDNAGRRQKHRLTCP SCDSYEKKPPKEFLERFKSLLQKMIHQHLSSRTHGSEDS | 0.922 | 1377 |
| IL-21_5665 | K81D, R114G, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGGRQKHTLTCP SCDSYEKKPPKEFLERFKSLLQKMIHQHLSSRTHGSEDS | 0.924 | 1378 |
| IL-21_5491 | N70G, K81D, P107V, R119T | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKVPSTNAGRRQKHTLTCP SCDSYEKKPPKEFLERFKSLLQKMIHQHLSSRTHGSEDS | 0.924 | 1379 |
| IL-21_6104 | H35I, T110D, R114Q, R115D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSDNAGQDQKHRLTCP SCDSYEKKPPKEFLERFKSLLQKMIHQHLSSRTHGSEDS | 0.925 | 1380 |
| IL-21_5164 | K81D, R115G, H118D, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRGQKDRLECP SCDSYEKKPPKEFLERFKSLLQKMIHQHLSSRTHGSEDS | 0.926 | 1381 |
| IL-21_5871 | I45T, V98E, R114G, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKPPSTNAGGGQKHRLTCP SCDSYEKKPPKEFLERFKSLLQKMIHQHLSSRTHGSEDS | 0.926 | 1382 |
| IL-21_5909 | I45T, K81D, V98E, R115G | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINESIKKLKRKPPSTNAGRGQKHRLTCP SCDSYEKKPPKEFLERFKSLLQKMIHQHLSSRTHGSEDS | 0.927 | 1383 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_6327 | H35F, N70G, K81D | MRSSPGNMERIVICLMVIFLGTLVHKSSSQGQDRFMIRMRQ LIDIVDQLKNYVNDLVPEFLPAPEDVETGCEWSAFSCFQDA QLKSANTGNNERIINVSIKKLKRKPPSTNAGRRQKHRLTCP SCDSYEKKPPKEFLERFKSLLQKMIHQHLSSRTHGSEDS | 0.927 | 1384 |
| IL-21_5988 | H35F, V98E, P107V, R115G | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINESIKKLKRKVPSTNAGRGQKHRLTCP SCDSYEKKPPKEFLERFKSLLQKMIHQHLSSRTHGSEDS | 0.929 | 1385 |
| IL-21_5652 | V98E, P107V, R114Q | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGQRQKHRLTCP SCDSYEKKPPKEFLERFKSLLQKMIHQHLSSRTHGSEDS | 0.929 | 1386 |
| IL-21_4968 | T110D, R114Q, R115D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGQDQKDRLTCP SCDSYEKKPPKEFLERFKSLLQKMIHQHLSSRTHGSEDS | 0.929 | 1387 |
| IL-21_5614 | V98E, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRRQKDTLTCP SCDSYEKKPPKEFLERFKSLLQKMIHQHLSSRTHGSEDS | 0.93 | 1388 |
| IL-21_5648 | V98E, P107V, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGRRQKDRLTCP SCDSYEKKPPKEFLERFKSLLQKMIHQHLSSRTHGSEDS | 0.93 | 1389 |
| IL-21_5769 | N70G, K81D, T110D | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSDNAGRRQKHRLTCP SCDSYEKKPPKEFLERFKSLLQKMIHQHLSSRTHGSEDS | 0.931 | 1390 |
| IL-21_5422 | N70G, V98E, R114G, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGGRQKHRLECP SCDSYEKKPPKEFLERFKSLLQKMIHQHLSSRTHGSEDS | 0.931 | 1391 |
| IL-21_5763 | N70G, K81D, H118D | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGRRQKDRLTCP SCDSYEKKPPKEFLERFKSLLQKMIHQHLSSRTHGSEDS | 0.931 | 1392 |
| IL-21_6082 | H35F, I45T, K81D, R114G | MRSSPGNMERIVICLMVIFLGTLVHKSSSQGQDREMIRMRQ LIDTVDQLKNYVNDLVPEFLPAPEDVETNCEWSAFSCFQDA QLKSANTGNNERIINVSIKKLKRKPPSTNAGGRQKHRLTCP SCDSYEKKPPKEFLERFKSLLQKMIHQHLSSRTHGSEDS | 0.931 | 1393 |
| IL-21_5627 | V98E, R114Q, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGQRQKHTLTCP SCDSYEKKPPKEFLERFKSLLQKMIHQHLSSRTHGSEDS | 0.932 | 1394 |
| IL-21_5904 | I45T, K81D, P107V, R115D | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKVPSTNAGRDQKHRLTCP SCDSYEKKPPKEFLERFKSLLQKMIHQHLSSRTHGSEDS | 0.933 | 1395 |
| IL-21_6135 | H35I, V98E, P107V, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKVPSTNAGRGQKHRLTCP SCDSYEKKPPKEFLERFKSLLQKMIHQHLSSRTHGSEDS | 0.933 | 1396 |
| IL-21_5677 | K81D, A112P, R115G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGRGQKHRLTCP SCDSYEKKPPKEFLERFKSLLQKMIHQHLSSRTHGSEDS | 0.933 | 1397 |
| IL-21_5592 | P107V, R114G, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGGDQKHRLTCP SCDSYEKKPPKEFLERFKSLLQKMIHQHLSSRTHGSEDS | 0.934 | 1398 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5761 | N70G, K81D, T121E | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGRRQKHRLECP SCDSYEKKPPKEFLERFKSLLQKMIHQHLSSRTHGSEDS | 0.934 | 1399 |
| IL-21_5039 | P107V, T110D, R115D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGRDQKHTLTCP SCDSYEKKPPKEFLERFKSLLQKMIHQHLSSRTHGSEDS | 0.935 | 1400 |
| IL-21_5617 | V98E, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRGQKDRLTCP SCDSYEKKPPKEFLERFKSLLQKMIHQHLSSRTHGSEDS | 0.935 | 1401 |
| IL-21_5986 | H35F, V98E, T110D, R114Q | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINESIKKLKRKPPSDNAGQRQKHRLTCP SCDSYEKKPPKEFLERFKSLLQKMIHQHLSSRTHGSEDS | 0.936 | 1402 |
| IL-21_5133 | V98E, P107V, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGRGQKDRLTCP SCDSYEKKPPKEFLERFKSLLQKMIHQHLSSRTHGSEDS | 0.937 | 1403 |
| IL-21_5671 | K81D, R114Q, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGQRQKDRLTCP SCDSYEKKPPKEFLERFKSLLQKMIHQHLSSRTHGSEDS | 0.937 | 1404 |
| IL-21_5622 | V98E, R114G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGGRQKHTLTCP SCDSYEKKPPKEFLERFKSLLQKMIHQHLSSRTHGSEDS | 0.938 | 1405 |
| IL-21_6137 | H35I, V98E, P107V, R114G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKVPSTNAGGRQKHRLTCP SCDSYEKKPPKEFLERFKSLLQKMIHQHLSSRTHGSEDS | 0.939 | 1406 |
| IL-21_5332 | N70G, R114Q, R115D, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGQDQKHTLTCP SCDSYEKKPPKEFLERFKSLLQKMIHQHLSSRTHGSEDS | 0.94 | 1407 |
| IL-21_5608 | P107V, T110D, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGRDQKHRLTCP SCDSYEKKPPKEFLERFKSLLQKMIHQHLSSRTHGSEDS | 0.941 | 1408 |
| IL-21_5126 | V98E, T110D, A112P, R114G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNPGGRQKHRLTCP SCDSYEKKPPKEFLERFKSLLQKMIHQHLSSRTHGSEDS | 0.941 | 1409 |
| IL-21_6233 | H35I, I45T, K81D, V98E | MRSSPGNMERIVICLMVIFLGTLVHKSSSQGQDRIMIRMRQ LIDTVDQLKNYVNDLVPEFLPAPEDVETNCEWSAFSCFQDA QLKSANTGNNERIINESIKKLKRKPPSTNAGRRQKHRLTCP SCDSYEKKPPKEFLERFKSLLQKMIHQHLSSRTHGSEDS | 0.942 | 1410 |
| IL-21_5764 | N70G, K81D, R115G | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGRGQKHRLTCP SCDSYEKKPPKEFLERFKSLLQKMIHQHLSSRTHGSEDS | 0.942 | 1411 |
| IL-21_5440 | N70G, V98E, T110D, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSDNAGRRQKHTLTCP SCDSYEKKPPKEFLERFKSLLQKMIHQHLSSRTHGSEDS | 0.942 | 1412 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5149 | V98E, P107V, A112P, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNPGRRQKDRLTCP SCDSYEKKPPKEFLERFKSLLQKMIHQHLSSRTHGSEDS | 0.943 | 1413 |
| IL-21_5993 | H35F, V98E, P107V, T110D | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINESIKKLKRKVPSDNAGRRQKHRLTCP SCDSYEKKPPKEFLERFKSLLQKMIHQHLSSRTHGSEDS | 0.944 | 1414 |
| IL-21_6138 | H35I, V98E, P107V, R114Q | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKVPSTNAGQRQKHRLTCP SCDSYEKKPPKEFLERFKSLLQKMIHQHLSSRTHGSEDS | 0.944 | 1415 |
| IL-21_5635 | V98E, A112P, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGRDQKHRLTCP SCDSYEKKPPKEFLERFKSLLQKMIHQHLSSRTHGSEDS | 0.946 | 1416 |
| IL-21_5455 | N70G, V98E, P107V, T110D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKVPSDNAGRRQKHRLTCP SCDSYEKKPPKEFLERFKSLLQKMIHQHLSSRTHGSEDS | 0.949 | 1417 |
| IL-21_5990 | H35F, V98E, P107V, R114G | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINESIKKLKRKVPSTNAGGRQKHRLTCP SCDSYEKKPPKEFLERFKSLLQKMIHQHLSSRTHGSEDS | 0.95 | 1418 |
| IL-21_5172 | K81D, R114G, R115G, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGGGQKHRLECP SCDSYEKKPPKEFLERFKSLLQKMIHQHLSSRTHGSEDS | 0.951 | 1419 |
| IL-21_6263 | I45T, V98E, R115D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKPPSTNAGRDQKHRLTCP SCDSYEKKPPKEFLERFKSLLQKMIHQHLSSRTHGSEDS | 0.953 | 1420 |
| IL-21_5666 | K81D, R114G, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGGRQKDRLTCP SCDSYEKKPPKEFLERFKSLLQKMIHQHLSSRTHGSEDS | 0.954 | 1421 |
| IL-21_5093 | V98E, A112P, R114G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGGRQKHTLTCP SCDSYEKKPPKEFLERFKSLLQKMIHQHLSSRTHGSEDS | 0.955 | 1422 |
| IL-21_5257 | K81D, P107V, A112P, R114Q | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNPGQRQKHRLTCP SCDSYEKKPPKEFLERFKSLLQKMIHQHLSSRTHGSEDS | 0.956 | 1423 |
| IL-21_5753 | N70G, V98E, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGRRQKDRLTCP SCDSYEKKPPKEFLERFKSLLQKMIHQHLSSRTHGSEDS | 0.956 | 1424 |
| IL-21_6364 | H35I, K81D, R115G | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSTNAGRGQKHRLTCP SCDSYEKKPPKEFLERFKSLLQKMIHQHLSSRTHGSEDS | 0.957 | 1425 |
| IL-21_5613 | V98E, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRRQKDRLECP SCDSYEKKPPKEFLERFKSLLQKMIHQHLSSRTHGSEDS | 0.957 | 1426 |
| IL-21_6006 | H35F, K81D, T110D, A112P | MRSSPGNMERIVICLMVIFLGTLVHKSSSQGQDRFMIRMRQ LIDIVDQLKNYVNDLVPEFLPAPEDVETNCEWSAFSCFQDA QLKSANTGNNERIINVSIKKLKRKPPSDNPGRRQKHRLTCP SCDSYEKKPPKEFLERFKSLLQKMIHQHLSSRTHGSEDS | 0.958 | 1427 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5098 | V98E, A112P, R114Q, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGQRQKHTLTCP SCDSYEKKPPKEFLERFKSLLQKMIHQHLSSRTHGSEDS | 0.958 | 1428 |
| IL-21_5183 | K81D, R114Q, R115G, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGQGQKDRLTCP SCDSYEKKPPKEFLERFKSLLQKMIHQHLSSRTHGSEDS | 0.958 | 1429 |
| IL-21_6231 | H35I, I45T, K81D, T110D | MRSSPGNMERIVICLMVIFLGTLVHKSSSQGQDRIMIRMRQ LIDTVDQLKNYVNDLVPEFLPAPEDVETNCEWSAFSCFQDA QLKSANTGNNERIINVSIKKLKRKPPSDNAGRRQKHRLTCP SCDSYEKKPPKEFLERFKSLLQKMIHQHLSSRTHGSEDS | 0.958 | 1430 |
| IL-21_5480 | N70G, K81D, A112P, R114G | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNPGGRQKHRLTCP SCDSYEKKPPKEFLERFKSLLQKMIHQHLSSRTHGSEDS | 0.958 | 1431 |
| IL-21_5237 | K81D, P107V, R115G, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGRGQKDRLTCP SCDSYEKKPPKEFLERFKSLLQKMIHQHLSSRTHGSEDS | 0.959 | 1432 |
| IL-21_4918 | R114Q, R115D, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGQDQKDTLTCP SCDSYEKKPPKEFLERFKSLLQKMIHQHLSSRTHGSEDS | 0.959 | 1433 |
| IL-21_6055 | H35F, I45T, R114G, R115D | MRSSPGNMERIVICLMVIFLGTLVHKSSSQGQDRFMIRMRQ LIDTVDQLKNYVNDLVPEFLPAPEDVETNCEWSAFSCFQKA QLKSANTGNNERIINVSIKKLKRKPPSTNAGGDQKHRLTCP SCDSYEKKPPKEFLERFKSLLQKMIHQHLSSRTHGSEDS | 0.96 | 1434 |
| IL-21_5827 | K81D, R115G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRGQKHRLTCP SCDSYEKKPPKEFLERFKSLLQKMIHQHLSSRTHGSEDS | 0.961 | 1435 |
| IL-21_5658 | K81D, R115G, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRGQKHRLECP SCDSYEKKPPKEFLERFKSLLQKMIHQHLSSRTHGSEDS | 0.963 | 1436 |
| IL-21_5152 | V98E, P107V, A112P, R114G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNPGGRQKHRLTCP SCDSYEKKPPKEFLERFKSLLQKMIHQHLSSRTHGSEDS | 0.966 | 1437 |
| IL-21_6224 | H35I, I45T, V98E, T110D | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINESIKKLKRKPPSDNAGRRQKHRLTCP SCDSYEKKPPKEFLERFKSLLQKMIHQHLSSRTHGSEDS | 0.966 | 1438 |
| IL-21_4904 | R115D, H118D, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGRDQKDTLECP SCDSYEKKPPKEFLERFKSLLQKMIHQHLSSRTHGSEDS | 0.967 | 1439 |
| IL-21_5912 | I45T, K81D, V98E, R114Q | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINESIKKLKRKPPSTNAGQRQKHRLTCP SCDSYEKKPPKEFLERFKSLLQKMIHQHLSSRTHGSEDS | 0.967 | 1440 |
| IL-21_6317 | H35F, K81D, P107V | MRSSPGNMERIVICLMVIFLGTLVHKSSSQGQDRFMIRMRQ LIDIVDQLKNYVNDLVPEFLPAPEDVETNCEWSAFSCFQDA QLKSANTGNNERIINVSIKKLKRKVPSTNAGRRQKHRLTCP SCDSYEKKPPKEFLERFKSLLQKMIHQHLSSRTHGSEDS | 0.968 | 1441 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5182 | K81D, R114Q, R115G, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGQGQKHTLTCP SCDSYEKKPPKEFLERFKSLLQKMIHQHLSSRTHGSEDS | 0.969 | 1442 |
| IL-21_5905 | I45T, K81D, P107V, R114G | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKVPSTNAGGRQKHRLTCP SCDSYEKKPPKEFLERFKSLLQKMIHQHLSSRTHGSEDS | 0.972 | 1443 |
| IL-21_6021 | H35F, N70G, R114G, R115D | MRSSPGNMERIVICLMVIFLGTLVHKSSSQGQDRFMIRMRQ LIDIVDQLKNYVNDLVPEFLPAPEDVETGCEWSAFSCFQKA QLKSANTGNNERIINVSIKKLKRKPPSTNAGGDQKHRLTCP SCDSYEKKPPKEFLERFKSLLQKMIHQHLSSRTHGSEDS | 0.974 | 1444 |
| IL-21_5253 | K81D, P107V, A112P, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNPGRRQKDRLTCP SCDSYEKKPPKEFLERFKSLLQKMIHQHLSSRTHGSEDS | 0.974 | 1445 |
| IL-21_6156 | H35I, K81D, P107V, R114G | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKVPSTNAGGRQKHRLTCP SCDSYEKKPPKEFLERFKSLLQKMIHQHLSSRTHGSEDS | 0.976 | 1446 |
| IL-21_5471 | N70G, K81D, R114Q, R119T | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGQRQKHTLTCP SCDSYEKKPPKEFLERFKSLLQKMIHQHLSSRTHGSEDS | 0.976 | 1447 |
| IL-21_5682 | K81D, T110D, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGRRQKHTLTCP SCDSYEKKPPKEFLERFKSLLQKMIHQHLSSRTHGSEDS | 0.977 | 1448 |
| IL-21_4950 | T110D, R115D, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRDQKDTLTCP SCDSYEKKPPKEFLERFKSLLQKMIHQHLSSRTHGSEDS | 0.978 | 1449 |
| IL-21_6304 | H35F, V98E, R115G | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINESIKKLKRKPPSTNAGRGQKHRLTCP SCDSYEKKPPKEFLERFKSLLQKMIHQHLSSRTHGSEDS | 0.979 | 1450 |
| IL-21_5754 | N70G, V98E, R115G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGRGQKHRLTCP SCDSYEKKPPKEFLERFKSLLQKMIHQHLSSRTHGSEDS | 0.981 | 1451 |
| IL-21_6362 | H35I, V98E, T110D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKPPSDNAGRRQKHRLTCP SCDSYEKKPPKEFLERFKSLLQKMIHQHLSSRTHGSEDS | 0.982 | 1452 |
| IL-21_5679 | K81D, A112P, R114G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGGRQKHRLTCP SCDSYEKKPPKEFLERFKSLLQKMIHQHLSSRTHGSEDS | 0.982 | 1453 |
| IL-21_5626 | V98E, R114Q, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGQRQKHRLECP SCDSYEKKPPKEFLERFKSLLQKMIHQHLSSRTHGSEDS | 0.982 | 1454 |
| IL-21_5644 | V98E, T110D, R114Q | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGQRQKHRLTCP SCDSYEKKPPKEFLERFKSLLQKMIHQHLSSRTHGSEDS | 0.982 | 1455 |
| IL-21_5050 | P107V, T110D, R114Q, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGQDQKHRLTCP SCDSYEKKPPKEFLERFKSLLQKMIHQHLSSRTHGSEDS | 0.983 | 1456 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5413 | N70G, V98E, R119T, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGRRQKHTLECP SCDSYEKKPPKEFLERFKSLLQKMIHQHLSSRTHGSEDS | 0.983 | 1457 |
| IL-21_5705 | K81D, V98E, A112P | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINESIKKLKRKPPSTNPGRRQKHRLTCP SCDSYEKKPPKEFLERFKSLLQKMIHQHLSSRTHGSEDS | 0.983 | 1458 |
| IL-21_4991 | P107V, R115G, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGRGQKDTLTCP SCDSYEKKPPKEFLERFKSLLQKMIHQHLSSRTHGSEDS | 0.985 | 1459 |
| IL-21_6242 | H35I, I45T, N70G, K81D | MRSSPGNMERIVICLMVIFLGTLVHKSSSQGQDRIMIRMRQ LIDTVDQLKNYVNDLVPEFLPAPEDVETGCEWSAFSCFQDA QLKSANTGNNERIINVSIKKLKRKPPSTNAGRRQKHRLTCP SCDSYEKKPPKEFLERFKSLLQKMIHQHLSSRTHGSEDS | 0.985 | 1460 |
| IL-21_4992 | P107V, R115D R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGRDQKHTLECP SCDSYEKKPPKEFLERFKSLLQKMIHQHLSSRTHGSEDS | 0.985 | 1461 |
| IL-21_5397 | N70G, P107V, R114Q, R115D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGQDQKHRLTCP SCDSYEKKPPKEFLERFKSLLQKMIHQHLSSRTHGSEDS | 0.986 | 1462 |
| IL-21_5892 | I45T, K81D, R114Q, R115G | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKPPSTNAGQGQKHRLTCP SCDSYEKKPPKEFLERFKSLLQKMIHQHLSSRTHGSEDS | 0.987 | 1463 |
| IL-21_5832 | K81D, T110D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGRRQKHRLTCP SCDSYEKKPPKEFLERFKSLLQKMIHQHLSSRTHGSEDS | 0.987 | 1464 |
| IL-21_5202 | K81D, A112P, R114Q, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGQRQKHTLTCP SCDSYEKKPPKEFLERFKSLLQKMIHQHLSSRTHGSEDS | 0.988 | 1465 |
| IL-21_6110 | H35I, P107V, R114G, R115D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKVPSTNAGGDQKHRLTCP SCDSYEKKPPKEFLERFKSLLQKMIHQHLSSRTHGSEDS | 0.988 | 1466 |
| IL-21_5323 | N70G, R114G, R115D, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGGDQKHTLTCP SCDSYEKKPPKEFLERFKSLLQKMIHQHLSSRTHGSEDS | 0.99 | 1467 |
| IL-21_6294 | H35F, T110D, R115D | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKPPSDNAGRDQKHRLTCP SCDSYEKKPPKEFLERFKSLLQKMIHQHLSSRTHGSEDS | 0.99 | 1468 |
| IL-21_5002 | P107V, R114G, R115D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGGDQKHTLTCP SCDSYEKKPPKEFLERFKSLLQKMIHQHLSSRTHGSEDS | 0.991 | 1469 |
| IL-21_5489 | N70G, K81D, T110D, A112P | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSDNPGRRQKHRLTCP SCDSYEKKPPKEFLERFKSLLQKMIHQHLSSRTHGSEDS | 0.991 | 1470 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5153 | V98E, P107V, A112P, R114Q | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNPGQRQKHRLTCP SCDSYEKKPPKEFLERFKSLLQKMIHQHLSSRTHGSEDS | 0.991 | 1471 |
| IL-21_5690 | K81D, P107V, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGRRQKHTLTCP SCDSYEKKPPKEFLERFKSLLQKMIHQHLSSRTHGSEDS | 0.993 | 1472 |
| IL-21_5429 | N70G, V98E, R114Q, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGQRQKDRLTCP SCDSYEKKPPKEFLERFKSLLQKMIHQHLSSRTHGSEDS | 0.993 | 1473 |
| IL-21_5895 | I45T, K81D, A112P, R115D | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKPPSTNPGRDQKHRLTCP SCDSYEKKPPKEFLERFKSLLQKMIHQHLSSRTHGSEDS | 0.993 | 1474 |
| IL-21_5252 | K81D, P107V, A112P, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNPGRRQKHTLTCP SCDSYEKKPPKEFLERFKSLLQKMIHQHLSSRTHGSEDS | 0.993 | 1475 |
| IL-21_5695 | K81D, P107V, R114Q | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGQRQKHRLTCP SCDSYEKKPPKEFLERFKSLLQKMIHQHLSSRTHGSEDS | 0.994 | 1476 |
| IL-21_5194 | K81D, A112P, R115D, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGRDQKHTLTCP SCDSYEKKPPKEFLERFKSLLQKMIHQHLSSRTHGSEDS | 0.994 | 1477 |
| IL-21_5973 | H35F, P107V, T110D, R114Q | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKVPSDNAGQRQKHRLTCP SCDSYEKKPPKEFLERFKSLLQKMIHQHLSSRTHGSEDS | 0.994 | 1478 |
| IL-21_5676 | K81D, A112P, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGRRQKDRLTCP SCDSYEKKPPKEFLERFKSLLQKMIHQHLSSRTHGSEDS | 0.994 | 1479 |
| IL-21_5903 | I45T, K81D, P107V, R115G | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKVPSTNAGRGQKHRLTCP SCDSYEKKPPKEFLERFKSLLQKMIHQHLSSRTHGSEDS | 0.995 | 1480 |
| IL-21_6270 | I45T, K81D, R115D | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKPPSTNAGRDQKHRLTCP SCDSYEKKPPKEFLERFKSLLQKMIHQHLSSRTHGSEDS | 0.995 | 1481 |
| IL-21_5691 | K81D, P107V, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGRRQKDRLTCP SCDSYEKKPPKEFLERFKSLLQKMIHQHLSSRTHGSEDS | 0.998 | 1482 |
| IL-21_5409 | N70G, P107V, T110D, R115D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSDNAGRDQKHRLTCP SCDSYEKKPPKEFLERFKSLLQKMIHQHLSSRTHGSEDS | 0.998 | 1483 |
| IL-21_5201 | K81D, A112P, R114Q, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGQRQKHRLECP SCDSYEKKPPKEFLERFKSLLQKMIHQHLSSRTHGSEDS | 0.998 | 1484 |
| IL-21_5956 | H35F, T110D, R114Q, R115G | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKPPSDNAGQGQKHRLTCP SCDSYEKKPPKEFLERFKSLLQKMIHQHLSSRTHGSEDS | 0.999 | 1485 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5150 | V98E, P107V, A112P, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNPGRGQKHRLTCP SCDSYEKKPPKEFLERFKSLLQKMIHQHLSSRTHGSEDS | 1 | 1486 |
| IL-21_6170 | H35I, N70G, R114Q, R115D | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKPPSTNAGQDQKHRLTCP SCDSYEKKPPKEFLERFKSLLQKMIHQHLSSRTHGSEDS | 1 | 1487 |
| IL-21_6158 | H35I, K81D, P107V, A112P | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKVPSTNPGRRQKHRLTCP SCDSYEKKPPKEFLERFKSLLQKMIHQHLSSRTHGSEDS | 1.001 | 1488 |
| IL-21_5853 | I45T, T110D, R114Q, R115D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSDNAGQDQKHRLTCP SCDSYEKKPPKEFLERFKSLLQKMIHQHLSSRTHGSEDS | 1.001 | 1489 |
| IL-21_5816 | V98E, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRRQKDRLTCP SCDSYEKKPPKEFLERFKSLLQKMIHQHLSSRTHGSEDS | 1.001 | 1490 |
| IL-21_5312 | N70G, R115G, H118D, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRGQKDTLTCP SCDSYEKKPPKEFLERFKSLLQKMIHQHLSSRTHGSEDS | 1.004 | 1491 |
| IL-21_5615 | V98E, R115G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRGQKHRLECP SCDSYEKKPPKEFLERFKSLLQKMIHQHLSSRTHGSEDS | 1.004 | 1492 |
| IL-21_5470 | N70G, K81D, R114Q, T121E | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGQRQKHRLECP SCDSYEKKPPKEFLERFKSLLQKMIHQHLSSRTHGSEDS | 1.006 | 1493 |
| IL-21_5752 | N70G, V98E, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGRRQKHTLTCP SCDSYEKKPPKEFLERFKSLLQKMIHQHLSSRTHGSEDS | 1.006 | 1494 |
| IL-21_6085 | H35F, I45T, K81D, T110D | MRSSPGNMERIVICLMVIFLGTLVHKSSSQGQDRFMIRMRQ LIDTVDQLKNYVNDLVPEFLPAPEDVETNCEWSAFSCFQDA QLKSANTGNNERIINVSIKKLKRKPPSDNAGRRQKHRLTCP SCDSYEKKPPKEFLERFKSLLQKMIHQHLSSRTHGSEDS | 1.008 | 1495 |
| IL-21_5251 | K81D, P107V, A112P, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNPGRRQKHRLECP SCDSYEKKPPKEFLERFKSLLQKMIHQHLSSRTHGSEDS | 1.009 | 1496 |
| IL-21_5037 | P107V, T110D, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGRGQKDRLTCP SCDSYEKKPPKEFLERFKSLLQKMIHQHLSSRTHGSEDS | 1.011 | 1497 |
| IL-21_4959 | T110D, R114G, R115D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGGDQKDRLTCP SCDSYEKKPPKEFLERFKSLLQKMIHQHLSSRTHGSEDS | 1.011 | 1498 |
| IL-21_5387 | N70G, P107V, R115D, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGRDQKDRLTCP SCDSYEKKPPKEFLERFKSLLQKMIHQHLSSRTHGSEDS | 1.012 | 1499 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_6118 | H35I, P107V, T110D, R115D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKVPSDNAGRDQKHRLTCP SCDSYEKKPPKEFLERFKSLLQKMIHQHLSSRTHGSEDS | 1.012 | 1500 |
| IL-21_5830 | K81D, R114Q | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGQRQKHRLTCP SCDSYEKKPPKEFLERFKSLLQKMIHQHLSSRTHGSEDS | 1.012 | 1501 |
| IL-21_6191 | H35I, N70G, V98E, P107V | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINESIKKLKRKVPSTNAGRRQKHRLTCP SCDSYEKKPPKEFLERFKSLLQKMIHQHLSSRTHGSEDS | 1.013 | 1502 |
| IL-21_5159 | V98E, P107V, T110D, R114G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSDNAGGRQKHRLTCP SCDSYEKKPPKEFLERFKSLLQKMIHQHLSSRTHGSEDS | 1.013 | 1503 |
| IL-21_5001 | P107V, R114G, R115D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGGDQKHRLECP SCDSYEKKPPKEFLERFKSLLQKMIHQHLSSRTHGSEDS | 1.013 | 1504 |
| IL-21_5092 | V98E, A112P, R114G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGGRQKHRLECP SCDSYEKKPPKEFLERFKSLLQKMIHQHLSSRTHGSEDS | 1.014 | 1505 |
| IL-21_5360 | N70G, T110D, R115D, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGRDQKHTLTCP SCDSYEKKPPKEFLERFKSLLQKMIHQHLSSRTHGSEDS | 1.014 | 1506 |
| IL-21_5943 | I45T, N70G, K81D, R115D | MRSSPGNMERIVICLMVIFLGTLVHKSSSQGQDRHMIRMRQ LIDTVDQLKNYVNDLVPEFLPAPEDVETGCEWSAFSCFQDA QLKSANTGNNERIINVSIKKLKRKPPSTNAGRDQKHRLTCP SCDSYEKKPPKEFLERFKSLLQKMIHQHLSSRTHGSEDS | 1.015 | 1507 |
| IL-21_5097 | V98E, A112P, R114Q, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGQRQKHRLECP SCDSYEKKPPKEFLERFKSLLQKMIHQHLSSRTHGSEDS | 1.015 | 1508 |
| IL-21_6222 | H351, I45T, V98E, R114Q | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINESIKKLKRKPPSTNAGQRQKHRLTCP SCDSYEKKPPKEFLERFKSLLQKMIHQHLSSRTHGSEDS | 1.018 | 1509 |
| IL-21_6380 | H35I, N70G, K81D | MRSSPGNMERIVICLMVIFLGTLVHKSSSQGQDRIMIRMRQ LIDIVDQLKNYVNDLVPEFLPAPEDVETGCEWSAFSCFQDA QLKSANTGNNERIINVSIKKLKRKPPSTNAGRRQKHRLTCP SCDSYEKKPPKEFLERFKSLLQKMIHQHLSSRTHGSEDS | 1.018 | 1510 |
| IL-21_5040 | P107V, T110D, R115D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGRDQKDRLTCP SCDSYEKKPPKEFLERFKSLLQKMIHQHLSSRTHGSEDS | 1.018 | 1511 |
| IL-21_5688 | K81D, T110D, A112P | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNPGRRQKHRLTCP SCDSYEKKPPKEFLERFKSLLQKMIHQHLSSRTHGSEDS | 1.019 | 1512 |
| IL-21_6075 | H35F, I45T, V98E, R114G | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINESIKKLKRKPPSTNAGGRQKHRLTCP SCDSYEKKPPKEFLERFKSLLQKMIHQHLSSRTHGSEDS | 1.019 | 1513 |
| IL-21_5639 | V98E, T110D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGRRQKHTLTCP SCDSYEKKPPKEFLERFKSLLQKMIHQHLSSRTHGSEDS | 1.02 | 1514 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_4943 | A112P, R114Q, R115D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGQDQKDRLTCP SCDSYEKKPPKEFLERFKSLLQKMIHQHLSSRTHGSEDS | 1.02 | 1515 |
| IL-21_4957 | T110D, R114G, R115D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGGDQKHRLECP SCDSYEKKPPKEFLERFKSLLQKMIHQHLSSRTHGSEDS | 1.02 | 1516 |
| IL-21_6148 | H35I, K81D, A112P, R114Q | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSTNPGQRQKHRLTCP SCDSYEKKPPKEFLERFKSLLQKMIHQHLSSRTHGSEDS | 1.02 | 1517 |
| IL-21_5192 | K81D, A112P, R115G, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGRGQKDRLTCP SCDSYEKKPPKEFLERFKSLLQKMIHQHLSSRTHGSEDS | 1.022 | 1518 |
| IL-21_6086 | H35F, I45T, K81D, P107V | MRSSPGNMERIVICLMVIFLGTLVHKSSSQGQDREMIRMRQ LIDTVDQLKNYVNDLVPEFLPAPEDVETNCEWSAFSCFQDA QLKSANTGNNERIINVSIKKLKRKVPSTNAGRRQKHRLTCP SCDSYEKKPPKEFLERFKSLLQKMIHQHLSSRTHGSEDS | 1.027 | 1519 |
| IL-21_5664 | K81D, R114G, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGGRQKHRLECP SCDSYEKKPPKEFLERFKSLLQKMIHQHLSSRTHGSEDS | 1.028 | 1520 |
| IL-21_5872 | I45T, V98E, R114G, R115D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKPPSTNAGGDQKHRLTCP SCDSYEKKPPKEFLERFKSLLQKMIHQHLSSRTHGSEDS | 1.028 | 1521 |
| IL-21_5456 | N70G, K81D, R119T, T121E | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGRRQKHTLECP SCDSYEKKPPKEFLERFKSLLQKMIHQHLSSRTHGSEDS | 1.028 | 1522 |
| IL-21_4966 | T110D, R114Q, R115D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGQDQKHRLECP SCDSYEKKPPKEFLERFKSLLQKMIHQHLSSRTHGSEDS | 1.029 | 1523 |
| IL-21_5435 | N70G, V98E, A112P, R115G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNPGRGQKHRLTCP SCDSYEKKPPKEFLERFKSLLQKMIHQHLSSRTHGSEDS | 1.029 | 1524 |
| IL-21_5683 | K81D, T110D, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGRRQKDRLTCP SCDSYEKKPPKEFLERFKSLLQKMIHQHLSSRTHGSEDS | 1.031 | 1525 |
| IL-21_4910 | R114G, R115D, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGGDQKDRLECP SCDSYEKKPPKEFLERFKSLLQKMIHQHLSSRTHGSEDS | 1.031 | 1526 |
| IL-21_5651 | V98E, P107V, R114G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGGRQKHRLTCP SCDSYEKKPPKEFLERFKSLLQKMIHQHLSSRTHGSEDS | 1.031 | 1527 |
| IL-21_6309 | H35F, V98E, T110D | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINESIKKLKRKPPSDNAGRRQKHRLTCP SCDSYEKKPPKEFLERFKSLLQKMIHQHLSSRTHGSEDS | 1.032 | 1528 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5225 | K81D, T110D, A112P, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNPGRRQKHRLECP SCDSYEKKPPKEFLERFKSLLQKMIHQHLSSRTHGSEDS | 1.032 | 1529 |
| IL-21_5189 | K81D, A112P, H118D, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGRRQKDTLTCP SCDSYEKKPPKEFLERFKSLLQKMIHQHLSSRTHGSEDS | 1.032 | 1530 |
| IL-21_5003 | P107V, R114G, R115D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGGDQKDRLTCP SCDSYEKKPPKEFLERFKSLLQKMIHQHLSSRTHGSEDS | 1.034 | 1531 |
| IL-21_6096 | H35F, I45T, N70G, K81D | MRSSPGNMERIVICLMVIFLGTLVHKSSSQGQDRFMIRMRQ LIDTVDQLKNYVNDLVPEFLPAPEDVETGCEWSAFSCFQDA QLKSANTGNNERIINVSIKKLKRKPPSTNAGRRQKHRLTCP SCDSYEKKPPKEFLERFKSLLQKMIHQHLSSRTHGSEDS | 1.034 | 1532 |
| IL-21_6169 | H35I, N70G, R114Q, R115G | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKPPSTNAGQGQKHRLTCP SCDSYEKKPPKEFLERFKSLLQKMIHQHLSSRTHGSEDS | 1.034 | 1533 |
| IL-21_6196 | H35I, N70G, K81D, A112P | MRSSPGNMERIVICLMVIFLGTLVHKSSSQGQDRIMIRMRQ LIDIVDQLKNYVNDLVPEFLPAPEDVETGCEWSAFSCFQDA QLKSANTGNNERIINVSIKKLKRKPPSTNPGRRQKHRLTCP SCDSYEKKPPKEFLERFKSLLQKMIHQHLSSRTHGSEDS | 1.035 | 1534 |
| IL-21_5370 | N70G, T110D, R114Q, R115G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGQGQKHRLTCP SCDSYEKKPPKEFLERFKSLLQKMIHQHLSSRTHGSEDS | 1.035 | 1535 |
| IL-21_5829 | K81D, R114G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGGRQKHRLTCP SCDSYEKKPPKEFLERFKSLLQKMIHQHLSSRTHGSEDS | 1.036 | 1536 |
| IL-21_6192 | H35I, N70G, K81D, R115G | MRSSPGNMERIVICLMVIFLGTLVHKSSSQGQDRIMIRMRQ LIDIVDQLKNYVNDLVPEFLPAPEDVETGCEWSAFSCFQDA QLKSANTGNNERIINVSIKKLKRKPPSTNAGRGQKHRLTCP SCDSYEKKPPKEFLERFKSLLQKMIHQHLSSRTHGSEDS | 1.036 | 1537 |
| IL-21_5256 | K81D, P107V, A112P, R114G | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNPGGRQKHRLTCP SCDSYEKKPPKEFLERFKSLLQKMIHQHLSSRTHGSEDS | 1.038 | 1538 |
| IL-21_6084 | H35F, I45T, K81D, A112P | MRSSPGNMERIVICLMVIFLGTLVHKSSSQGQDRFMIRMRQ LIDTVDQLKNYVNDLVPEFLPAPEDVETNCEWSAFSCFQDA QLKSANTGNNERIINVSIKKLKRKPPSTNPGRRQKHRLTCP SCDSYEKKPPKEFLERFKSLLQKMIHQHLSSRTHGSEDS | 1.039 | 1539 |
| IL-21_5945 | I45T, N70G, K81D, R114Q | MRSSPGNMERIVICLMVIFLGTLVHKSSSQGQDRHMIRMRQ LIDTVDQLKNYVNDLVPEFLPAPEDVETGCEWSAFSCFQDA QLKSANTGNNERIINVSIKKLKRKPPSTNAGQRQKHRLTCP SCDSYEKKPPKEFLERFKSLLQKMIHQHLSSRTHGSEDS | 1.042 | 1540 |
| IL-21_5770 | N70G, K81D, P107V | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKVPSTNAGRRQKHRLTCP SCDSYEKKPPKEFLERFKSLLQKMIHQHLSSRTHGSEDS | 1.043 | 1541 |
| IL-21_5178 | K81D, R114Q, R119T, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGQRQKHTLECP SCDSYEKKPPKEFLERFKSLLQKMIHQHLSSRTHGSEDS | 1.045 | 1542 |
| IL-21_6023 | H35F, N70G, R114Q, R115D | MRSSPGNMERIVICLMVIFLGTLVHKSSSQGQDREMIRMRQ LIDIVDQLKNYVNDLVPEFLPAPEDVETGCEWSAFSCFQKA QLKSANTGNNERIINVSIKKLKRKPPSTNAGQDQKHRLTCP SCDSYEKKPPKEFLERFKSLLQKMIHQHLSSRTHGSEDS | 1.047 | 1543 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5475 | N70G, K81D, A112P, T121E | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNPGRRQKHRLECP SCDSYEKKPPKEFLERFKSLLQKMIHQHLSSRTHGSEDS | 1.048 | 1544 |
| IL-21_5433 | N70G, V98E, A112P, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNPGRRQKHTLTCP SCDSYEKKPPKEFLERFKSLLQKMIHQHLSSRTHGSEDS | 1.048 | 1545 |
| IL-21_5637 | V98E, A112P, R114Q | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGQRQKHRLTCP SCDSYEKKPPKEFLERFKSLLQKMIHQHLSSRTHGSEDS | 1.048 | 1546 |
| IL-21_4917 | R114Q, R115, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGQDQKDRLECP SCDSYEKKPPKEFLERFKSLLQKMIHQHLSSRTHGSEDS | 1.049 | 1547 |
| IL-21_5645 | V98E, T110D, A112P | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNPGRRQKHRLTCP SCDSYEKKPPKEFLERFKSLLQKMIHQHLSSRTHGSEDS | 1.052 | 1548 |
| IL-21_5196 | K81D, A112P, R114G, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGGRQKHRLECP SCDSYEKKPPKEFLERFKSLLQKMIHQHLSSRTHGSEDS | 1.052 | 1549 |
| IL-21_5322 | N70G, R114G, R115D, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGGDQKHRLECP SCDSYEKKPPKEFLERFKSLLQKMIHQHLSSRTHGSEDS | 1.052 | 1550 |
| IL-21_5448 | N70G, V98E, P107V, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKVPSTNAGRRQKHTLTCP SCDSYEKKPPKEFLERFKSLLQKMIHQHLSSRTHGSEDS | 1.053 | 1551 |
| IL-21_5587 | P107V, R115D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGRDQKDRLTCP SCDSYEKKPPKEFLERFKSLLQKMIHQHLSSRTHGSEDS | 1.054 | 1552 |
| IL-21_5447 | N70G, V98E, P107V, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKVPSTNAGRRQKHRLECP SCDSYEKKPPKEFLERFKSLLQKMIHQHLSSRTHGSEDS | 1.054 | 1553 |
| IL-21_5026 | P107V, A112P, R114G, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGGDQKHRLTCP SCDSYEKKPPKEFLERFKSLLQKMIHQHLSSRTHGSEDS | 1.055 | 1554 |
| IL-21_6175 | H35I, N70G, T110D, R115G | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKPPSDNAGRGQKHRLTCP SCDSYEKKPPKEFLERFKSLLQKMIHQHLSSRTHGSEDS | 1.055 | 1555 |
| IL-21_6194 | H35I, N70G, K81D, R114G | MRSSPGNMERIVICLMVIFLGTLVHKSSSQGQDRIMIRMRQ LIDIVDQLKNYVNDLVPEFLPAPEDVETGCEWSAFSCFQDA QLKSANTGNNERIINVSIKKLKRKPPSTNAGGRQKHRLTCP SCDSYEKKPPKEFLERFKSLLQKMIHQHLSSRTHGSEDS | 1.055 | 1556 |
| IL-21_5766 | N70G, K81D, R114G | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGGRQKHRLTCP SCDSYEKKPPKEFLERFKSLLQKMIHQHLSSRTHGSEDS | 1.056 | 1557 |
| IL-21_5726 | N70G, R114Q, R115D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGQDQKHRLTCP SCDSYEKKPPKEFLERFKSLLQKMIHQHLSSRTHGSEDS | 1.056 | 1558 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5944 | I45T, N70G, K81D, R114G | MRSSPGNMERIVICLMVIFLGTLVHKSSSQGQDRHMIRMRQ LIDTVDQLKNYVNDLVPEFLPAPEDVETGCEWSAFSCFQDA QLKSANTGNNERIINVSIKKLKRKPPSTNAGGRQKHRLTCP SCDSYEKKPPKEFLERFKSLLQKMIHQHLSSRTHGSEDS | 1.057 | 1559 |
| IL-21_4997 | P107V, R114G, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGGRQKDTLTCP SCDSYEKKPPKEFLERFKSLLQKMIHQHLSSRTHGSEDS | 1.057 | 1560 |
| IL-21_5982 | H35F, V98E, A112P, R114Q | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINESIKKLKRKPPSTNPGQRQKHRLTCP SCDSYEKKPPKEFLERFKSLLQKMIHQHLSSRTHGSEDS | 1.058 | 1561 |
| IL-21_5942 | I45T, N70G, K81D, R115G | MRSSPGNMERIVICLMVIFLGTLVHKSSSQGQDRHMIRMRQ LIDTVDQLKNYVNDLVPEFLPAPEDVETGCEWSAFSCFQDA QLKSANTGNNERIINVSIKKLKRKPPSTNAGRGQKHRLTCP SCDSYEKKPPKEFLERFKSLLQKMIHQHLSSRTHGSEDS | 1.058 | 1562 |
| IL-21_6011 | H35F, K81D, P107V, A112P | MRSSPGNMERIVICLMVIFLGTLVHKSSSQGQDREMIRMRQ LIDIVDQLKNYVNDLVPEFLPAPEDVETNCEWSAFSCFQDA QLKSANTGNNERIINVSIKKLKRKVPSTNPGRRQKHRLTCP SCDSYEKKPPKEFLERFKSLLQKMIHQHLSSRTHGSEDS | 1.059 | 1563 |
| IL-21_5959 | H35F, T110D, A112P, R115D | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKPPSDNPGRDQKHRLTCP SCDSYEKKPPKEFLERFKSLLQKMIHQHLSSRTHGSEDS | 1.059 | 1564 |
| IL-21_5010 | P107V, R114Q, R115D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGQDQKHRLECP SCDSYEKKPPKEFLERFKSLLQKMIHQHLSSRTHGSEDS | 1.06 | 1565 |
| IL-21_6076 | H35F, I45T, V98E, R114Q | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINESIKKLKRKPPSTNAGQRQKHRLTCP SCDSYEKKPPKEFLERFKSLLQKMIHQHLSSRTHGSEDS | 1.06 | 1566 |
| IL-21_5820 | V98E, R114Q | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGQRQKHRLTCP SCDSYEKKPPKEFLERFKSLLQKMIHQHLSSRTHGSEDS | 1.061 | 1567 |
| IL-21_5951 | H35F, A112P, R114G, R115D | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKPPSTNPGGDQKHRLTCP SCDSYEKKPPKEFLERFKSLLQKMIHQHLSSRTHGSEDS | 1.062 | 1568 |
| IL-21_5226 | K81D, T110D, A112P, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNPGRRQKHTLTCP SCDSYEKKPPKEFLERFKSLLQKMIHQHLSSRTHGSEDS | 1.062 | 1569 |
| IL-21_6029 | H35F, N70G, T110D, R115D | MRSSPGNMERIVICLMVIFLGTLVHKSSSQGQDRFMIRMRQ LIDIVDQLKNYVNDLVPEFLPAPEDVETGCEWSAFSCFQKA QLKSANTGNNERIINVSIKKLKRKPPSDNAGRDQKHRLTCP SCDSYEKKPPKEFLERFKSLLQKMIHQHLSSRTHGSEDS | 1.062 | 1570 |
| IL-21_6366 | H35I, K81D, R114G | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSTNAGGRQKHRLTCP SCDSYEKKPPKEFLERFKSLLQKMIHQHLSSRTHGSEDS | 1.063 | 1571 |
| IL-21_5881 | I45T, V98E, T110D, R114G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKPPSDNAGGRQKHRLTCP SCDSYEKKPPKEFLERFKSLLQKMIHQHLSSRTHGSEDS | 1.063 | 1572 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_6151 | H35I, K81D, T110D, R114G | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSDNAGGRQKHRLTCP SCDSYEKKPPKEFLERFKSLLQKMIHQHLSSRTHGSEDS | 1.064 | 1573 |
| IL-21_5038 | P107V, T110D, R115D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGRDQKHRLECP SCDSYEKKPPKEFLERFKSLLQKMIHQHLSSRTHGSEDS | 1.064 | 1574 |
| IL-21_5321 | N70G, R114G, R115G, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGGGQKDRLTCP SCDSYEKKPPKEFLERFKSLLQKMIHQHLSSRTHGSEDS | 1.064 | 1575 |
| IL-21_5477 | N70G, K81D, A112P, H118D | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNPGRRQKDRLTCP SCDSYEKKPPKEFLERFKSLLQKMIHQHLSSRTHGSEDS | 1.065 | 1576 |
| IL-21_5897 | I45T, K81D, A112P, R114Q | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKPPSTNPGQRQKHRLTCP SCDSYEKKPPKEFLERFKSLLQKMIHQHLSSRTHGSEDS | 1.066 | 1577 |
| IL-21_5970 | H35F, P107V, T110D, R115G | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKVPSDNAGRGQKHRLTCP SCDSYEKKPPKEFLERFKSLLQKMIHQHLSSRTHGSEDS | 1.066 | 1578 |
| IL-21_6168 | H35I, N70G, R114G, R115D | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKPPSTNAGGDQKHRLTCP SCDSYEKKPPKEFLERFKSLLQKMIHQHLSSRTHGSEDS | 1.066 | 1579 |
| IL-21_5887 | I45T, V98E, P107V, R114Q | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKVPSTNAGQRQKHRLTCP SCDSYEKKPPKEFLERFKSLLQKMIHQHLSSRTHGSEDS | 1.067 | 1580 |
| IL-21_5757 | N70G, V98E, R114Q | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGQRQKHRLTCP SCDSYEKKPPKEFLERFKSLLQKMIHQHLSSRTHGSEDS | 1.069 | 1581 |
| IL-21_5882 | I45T, V98E, T110D, R114Q | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKPPSDNAGQRQKHRLTCP SCDSYEKKPPKEFLERFKSLLQKMIHQHLSSRTHGSEDS | 1.069 | 1582 |
| IL-21_6315 | H35F, K81D, A112P | MRSSPGNMERIVICLMVIFLGTLVHKSSSQGQDREMIRMRQ LIDIVDQLKNYVNDLVPEFLPAPEDVETNCEWSAFSCFQDA QLKSANTGNNERIINVSIKKLKRKPPSTNPGRRQKHRLTCP SCDSYEKKPPKEFLERFKSLLQKMIHQHLSSRTHGSEDS | 1.071 | 1583 |
| IL-21_5647 | V98E, P107V, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGRRQKHTLTCP SCDSYEKKPPKEFLERFKSLLQKMIHQHLSSRTHGSEDS | 1.072 | 1584 |
| IL-21_5187 | K81D, A112P, R119T, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGRRQKHTLECP SCDSYEKKPPKEFLERFKSLLQKMIHQHLSSRTHGSEDS | 1.073 | 1585 |
| IL-21_5879 | I45T, V98E, T110D, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKPPSDNAGRGQKHRLTCP SCDSYEKKPPKEFLERFKSLLQKMIHQHLSSRTHGSEDS | 1.073 | 1586 |
| IL-21_5890 | I45T, K81D, R114G, R115G | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKPPSTNAGGGQKHRLTCP SCDSYEKKPPKEFLERFKSLLQKMIHQHLSSRTHGSEDS | 1.073 | 1587 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_6288 | H35F, R114Q, R115D | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKPPSTNAGQDQKHRLTCP SCDSYEKKPPKEFLERFKSLLQKMIHQHLSSRTHGSEDS | 1.073 | 1588 |
| IL-21_5681 | K81D, T110D, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSDNAGRRQKHRLECP SCDSYEKKPPKEFLERFKSLLQKMIHQHLSSRTHGSEDS | 1.074 | 1589 |
| IL-21_5947 | I45T, N70G, K81D, T110D | MRSSPGNMERIVICLMVIFLGTLVHKSSSQGQDRHMIRMRQ LIDTVDQLKNYVNDLVPEFLPAPEDVETGCEWSAFSCFQDA QLKSANTGNNERIINVSIKKLKRKPPSDNAGRRQKHRLTCP SCDSYEKKPPKEFLERFKSLLQKMIHQHLSSRTHGSEDS | 1.075 | 1590 |
| IL-21_4952 | T110D, R114G, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGGRQKDRLECP SCDSYEKKPPKEFLERFKSLLQKMIHQHLSSRTHGSEDS | 1.076 | 1591 |
| IL-21_4911 | R114G, R115D, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGGDQKDTLTCP SCDSYEKKPPKEFLERFKSLLQKMIHQHLSSRTHGSEDS | 1.076 | 1592 |
| IL-21_5634 | V98E, A112P, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGRGQKHRLTCP SCDSYEKKPPKEFLERFKSLLQKMIHQHLSSRTHGSEDS | 1.077 | 1593 |
| IL-21_6221 | H35I, I45T, V98E, R114G | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINESIKKLKRKPPSTNAGGRQKHRLTCP SCDSYEKKPPKEFLERFKSLLQKMIHQHLSSRTHGSEDS | 1.078 | 1594 |
| IL-21_5122 | V98E, T110D, A112P, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNPGRRQKHTLTCP SCDSYEKKPPKEFLERFKSLLQKMIHQHLSSRTHGSEDS | 1.078 | 1595 |
| IL-21_5621 | V98E, R114G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGGRQKHRLECP SCDSYEKKPPKEFLERFKSLLQKMIHQHLSSRTHGSEDS | 1.08 | 1596 |
| IL-21_6057 | H35F, I45T, R114Q, R115D | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINVSIKKLKRKPPSTNAGQDQKHRLTCP SCDSYEKKPPKEFLERFKSLLQKMIHQHLSSRTHGSEDS | 1.083 | 1597 |
| IL-21_6025 | H35F, N70G, A112P, R115D | MRSSPGNMERIVICLMVIFLGTLVHKSSSQGQDRFMIRMRQ LIDIVDQLKNYVNDLVPEFLPAPEDVETGCEWSAFSCFQKA QLKSANTGNNERIINVSIKKLKRKPPSTNPGRDQKHRLTCP SCDSYEKKPPKEFLERFKSLLQKMIHQHLSSRTHGSEDS | 1.084 | 1598 |
| IL-21_5347 | N70G, A112P, R114G, R115D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGGDQKHRLTCP SCDSYEKKPPKEFLERFKSLLQKMIHQHLSSRTHGSEDS | 1.084 | 1599 |
| IL-21_4967 | T110D, R114Q, R115D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGQDQKHTLTCP SCDSYEKKPPKEFLERFKSLLQKMIHQHLSSRTHGSEDS | 1.084 | 1600 |
| IL-21_5867 | I45T, P107V, T110D, R115D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKVPSDNAGRDQKHRLTCP SCDSYEKKPPKEFLERFKSLLQKMIHQHLSSRTHGSEDS | 1.084 | 1601 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5885 | I45T, V98E, P107V, R115D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKVPSTNAGRDQKHRLTCP SCDSYEKKPPKEFLERFKSLLQKMIHQHLSSRTHGSEDS | 1.084 | 1602 |
| IL-21_5913 | I45T, K81D, V98E, A112P | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINESIKKLKRKPPSTNPGRRQKHRLTCP SCDSYEKKPPKEFLERFKSLLQKMIHQHLSSRTHGSEDS | 1.085 | 1603 |
| IL-21_5355 | N70G, T110D, H118D, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGRRQKDTLTCP SCDSYEKKPPKEFLERFKSLLQKMIHQHLSSRTHGSEDS | 1.085 | 1604 |
| IL-21_5987 | H35F, V98E, T110D, A112P | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINESIKKLKRKPPSDNPGRRQKHRLTCP SCDSYEKKPPKEFLERFKSLLQKMIHQHLSSRTHGSEDS | 1.085 | 1605 |
| IL-21_5391 | N70G, P107V, R114G, R115G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGGGQKHRLTCP SCDSYEKKPPKEFLERFKSLLQKMIHQHLSSRTHGSEDS | 1.087 | 1606 |
| IL-21_5901 | I45T, K81D, T110D, R114Q | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKPPSDNAGQRQKHRLTCP SCDSYEKKPPKEFLERFKSLLQKMIHQHLSSRTHGSEDS | 1.088 | 1607 |
| IL-21_5721 | N70G, R114G, R115D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGGDQKHRLTCP SCDSYEKKPPKEFLERFKSLLQKMIHQHLSSRTHGSEDS | 1.089 | 1608 |
| IL-21_6022 | H35F, N70G, R114Q, R115G | MRSSPGNMERIVICLMVIFLGTLVHKSSSQGQDREMIRMRQ LIDIVDQLKNYVNDLVPEFLPAPEDVETGCEWSAFSCFQKA QLKSANTGNNERIINVSIKKLKRKPPSTNAGQGQKHRLTCP SCDSYEKKPPKEFLERFKSLLQKMIHQHLSSRTHGSEDS | 1.089 | 1609 |
| IL-21_5636 | V98E, A112P, R114G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGGRQKHRLTCP SCDSYEKKPPKEFLERFKSLLQKMIHQHLSSRTHGSEDS | 1.089 | 1610 |
| IL-21_5896 | I45T, K81D, A112P, R114G | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKPPSTNPGGRQKHRLTCP SCDSYEKKPPKEFLERFKSLLQKMIHQHLSSRTHGSEDS | 1.09 | 1611 |
| IL-21_5011 | P107V, R114Q, R115D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGQDQKHTLTCP SCDSYEKKPPKEFLERFKSLLQKMIHQHLSSRTHGSEDS | 1.093 | 1612 |
| IL-21_5654 | V98E, P107V, T110D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSDNAGRRQKHRLTCP SCDSYEKKPPKEFLERFKSLLQKMIHQHLSSRTHGSEDS | 1.094 | 1613 |
| IL-21_4905 | R114G, H118D, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGGRQKDTLECP SCDSYEKKPPKEFLERFKSLLQKMIHQHLSSRTHGSEDS | 1.094 | 1614 |
| IL-21_5009 | P107V, R114Q, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGQGQKDRLTCP SCDSYEKKPPKEFLERFKSLLQKMIHQHLSSRTHGSEDS | 1.097 | 1615 |
| IL-21_6043 | H35F, N70G, V98E, A112P | MRSSPGNMERIVICLMVIFLGTLVHKSSSQGQDRFMIRMRQ LIDIVDQLKNYVNDLVPEFLPAPEDVETGCEWSAFSCFQKA QLKSANTGNNERIINESIKKLKRKPPSTNPGRRQKHRLTCP SCDSYEKKPPKEFLERFKSLLQKMIHQHLSSRTHGSEDS | 1.097 | 1616 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5670 | K81D, R114Q, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGQRQKHTLTCP SCDSYEKKPPKEFLERFKSLLQKMIHQHLSSRTHGSEDS | 1.099 | 1617 |
| IL-21_5819 | V98E, R114G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGGRQKHRLTCP SCDSYEKKPPKEFLERFKSLLQKMIHQHLSSRTHGSEDS | 1.1 | 1618 |
| IL-21_5972 | H35F, P107V, T110D, R114G | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKVPSDNAGGRQKHRLTCP SCDSYEKKPPKEFLERFKSLLQKMIHQHLSSRTHGSEDS | 1.101 | 1619 |
| IL-21_4924 | A112P, R115D, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRDQKDRLECP SCDSYEKKPPKEFLERFKSLLQKMIHQHLSSRTHGSEDS | 1.102 | 1620 |
| IL-21_4977 | T110D, A112P, R115D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGRDQKDRLTCP SCDSYEKKPPKEFLERFKSLLQKMIHQHLSSRTHGSEDS | 1.102 | 1621 |
| IL-21_5876 | I45T, V98E, A112P, R115D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKPPSTNPGRDQKHRLTCP SCDSYEKKPPKEFLERFKSLLQKMIHQHLSSRTHGSEDS | 1.103 | 1622 |
| IL-21_5044 | P107V, T110D, R114G, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGGGQKHRLTCP SCDSYEKKPPKEFLERFKSLLQKMIHQHLSSRTHGSEDS | 1.103 | 1623 |
| IL-21_6419 | H35I, V98E | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKPPSTNAGRRQKHRLTCP SCDSYEKKPPKEFLERFKSLLQKMIHQHLSSRTHGSEDS | 1.104 | 1624 |
| IL-21_6360 | H35I, V98E, R114Q | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKPPSTNAGQRQKHRLTCP SCDSYEKKPPKEFLERFKSLLQKMIHQHLSSRTHGSEDS | 1.105 | 1625 |
| IL-21_5873 | I45T, V98E, 1R14Q, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKPPSTNAGQGQKHRLTCP SCDSYEKKPPKEFLERFKSLLQKMIHQHLSSRTHGSEDS | 1.105 | 1626 |
| IL-21_5751 | N70G, V98E, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGRRQKHRLECP SCDSYEKKPPKEFLERFKSLLQKMIHQHLSSRTHGSEDS | 1.105 | 1627 |
| IL-21_5314 | N70G, R115D, H118D, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRDQKDRLECP SCDSYEKKPPKEFLERFKSLLQKMIHQHLSSRTHGSEDS | 1.107 | 1628 |
| IL-21_6045 | H35F, N70G, V98E, P107V | MRSSPGNMERIVICLMVIFLGTLVHKSSSQGQDREMIRMRQ LIDIVDQLKNYVNDLVPEFLPAPEDVETGCEWSAFSCFQKA QLKSANTGNNERIINESIKKLKRKVPSTNAGRRQKHRLTCP SCDSYEKKPPKEFLERFKSLLQKMIHQHLSSRTHGSEDS | 1.109 | 1629 |
| IL-21_5161 | V98E, P107V, T110D, A112P | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSDNPGRRQKHRLTCP SCDSYEKKPPKEFLERFKSLLQKMIHQHLSSRTHGSEDS | 1.11 | 1630 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5497 | N70G, K81D, P107V, A112P | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKVPSTNPGRRQKHRLTCP SCDSYEKKPPKEFLERFKSLLQKMIHQHLSSRTHGSEDS | 1.11 | 1631 |
| IL-21_5330 | N70G, R114Q, R115G, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGQGQKDRLTCP SCDSYEKKPPKEFLERFKSLLQKMIHQHLSSRTHGSEDS | 1.11 | 1632 |
| IL-21_4909 | R114G, R115D, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGGDQKHTLECP SCDSYEKKPPKEFLERFKSLLQKMIHQHLSSRTHGSEDS | 1.11 | 1633 |
| IL-21_5369 | N70G, T110D, R114Q, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGQRQKDRLTCP SCDSYEKKPPKEFLERFKSLLQKMIHQHLSSRTHGSEDS | 1.111 | 1634 |
| IL-21_5817 | V98E, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRGQKHRLTCP SCDSYEKKPPKEFLERFKSLLQKMIHQHLSSRTHGSEDS | 1.112 | 1635 |
| IL-21_5571 | T110D, R114Q, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGQDQKHRLTCP SCDSYEKKPPKEFLERFKSLLQKMIHQHLSSRTHGSEDS | 1.113 | 1636 |
| IL-21_5086 | V98E, A112P, R115G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGRGQKHRLECP SCDSYEKKPPKEFLERFKSLLQKMIHQHLSSRTHGSEDS | 1.113 | 1637 |
| IL-21_6063 | H35F, I45T, T110D, R115D | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINVSIKKLKRKPPSDNAGRDQKHRLTCP SCDSYEKKPPKEFLERFKSLLQKMIHQHLSSRTHGSEDS | 1.114 | 1638 |
| IL-21_6285 | H35F, R114G, R115G | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKPPSTNAGGGQKHRLTCP SCDSYEKKPPKEFLERFKSLLQKMIHQHLSSRTHGSEDS | 1.114 | 1639 |
| IL-21_6310 | H35F, V98E, P107V | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINESIKKLKRKVPSTNAGRRQKHRLTCP SCDSYEKKPPKEFLERFKSLLQKMIHQHLSSRTHGSEDS | 1.115 | 1640 |
| IL-21_4965 | T110D, R114Q, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGQGQKDRLTCP SCDSYEKKPPKEFLERFKSLLQKMIHQHLSSRTHGSEDS | 1.116 | 1641 |
| IL-21_5142 | V98E, P107V, R114Q, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGQRQKHRLECP SCDSYEKKPPKEFLERFKSLLQKMIHQHLSSRTHGSEDS | 1.117 | 1642 |
| IL-21_6109 | H35I, P107V, R114G, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKVPSTNAGGGQKHRLTCP SCDSYEKKPPKEFLERFKSLLQKMIHQHLSSRTHGSEDS | 1.119 | 1643 |
| IL-21_5762 | N70G, K81D, R119T | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGRRQKHTLTCP SCDSYEKKPPKEFLERFKSLLQKMIHQHLSSRTHGSEDS | 1.121 | 1644 |
| IL-21_5000 | P107V, R114G, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGGGQKDRLTCP SCDSYEKKPPKEFLERFKSLLQKMIHQHLSSRTHGSEDS | 1.121 | 1645 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5937 | I45T, N70G, V98E, R114G | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINESIKKLKRKPPSTNAGGRQKHRLTCP SCDSYEKKPPKEFLERFKSLLQKMIHQHLSSRTHGSEDS | 1.122 | 1646 |
| IL-21_4914 | R114Q, R115G, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGQGQKDRLECP SCDSYEKKPPKEFLERFKSLLQKMIHQHLSSRTHGSEDS | 1.123 | 1647 |
| IL-21_5318 | N70G, R114G, H118D, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGGRQKDTLTCP SCDSYEKKPPKEFLERFKSLLQKMIHQHLSSRTHGSEDS | 1.127 | 1648 |
| IL-21_6363 | H35I, V98E, P107V | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKVPSTNAGRRQKHRLTCP SCDSYEKKPPKEFLERFKSLLQKMIHQHLSSRTHGSEDS | 1.127 | 1649 |
| IL-21_6369 | H35I, K81D, T110D | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSDNAGRRQKHRLTCP SCDSYEKKPPKEFLERFKSLLQKMIHQHLSSRTHGSEDS | 1.129 | 1650 |
| IL-21_4976 | T110D, A112P, R115D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGRDQKHTLTCP SCDSYEKKPPKEFLERFKSLLQKMIHQHLSSRTHGSEDS | 1.129 | 1651 |
| IL-21_6339 | H35I, R114G, R115D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSTNAGGDQKHRLTCP SCDSYEKKPPKEFLERFKSLLQKMIHQHLSSRTHGSEDS | 1.13 | 1652 |
| IL-21_5021 | P107V, A112P, R115D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGRDQKDRLTCP SCDSYEKKPPKEFLERFKSLLQKMIHQHLSSRTHGSEDS | 1.132 | 1653 |
| IL-21_5006 | P107V, R114Q, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGQRQKDTLTCP SCDSYEKKPPKEFLERFKSLLQKMIHQHLSSRTHGSEDS | 1.132 | 1654 |
| IL-21_5048 | P107V, T110D, R114Q, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGQRQKDRLTCP SCDSYEKKPPKEFLERFKSLLQKMIHQHLSSRTHGSEDS | 1.133 | 1655 |
| IL-21_5042 | P107V, T110D, R114G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGGRQKHTLTCP SCDSYEKKPPKEFLERFKSLLQKMIHQHLSSRTHGSEDS | 1.135 | 1656 |
| IL-21_4925 | A112P, R115D, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRDQKDTLTCP SCDSYEKKPPKEFLERFKSLLQKMIHQHLSSRTHGSEDS | 1.136 | 1657 |
| IL-21_5940 | I45T, N70G, V98E, T110D | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINESIKKLKRKPPSDNAGRRQKHRLTCP SCDSYEKKPPKEFLERFKSLLQKMIHQHLSSRTHGSEDS | 1.136 | 1658 |
| IL-21_5043 | P107V, T110D, R114G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGGRQKDRLTCP SCDSYEKKPPKEFLERFKSLLQKMIHQHLSSRTHGSEDS | 1.139 | 1659 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5188 | K81D, A112P, H118D, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGRRQKDRLECP SCDSYEKKPPKEFLERFKSLLQKMIHQHLSSRTHGSEDS | 1.139 | 1660 |
| IL-21_5386 | N70G, P107V, R115D, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGRDQKHTLTCP SCDSYEKKPPKEFLERFKSLLQKMIHQHLSSRTHGSEDS | 1.143 | 1661 |
| IL-21_6167 | H35I, N70G, R114G, R115G | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKPPSTNAGGGQKHRLTCP SCDSYEKKPPKEFLERFKSLLQKMIHQHLSSRTHGSEDS | 1.143 | 1662 |
| IL-21_5894 | I45T, K81D, A112P, R115G | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKPPSTNPGRGQKHRLTCP SCDSYEKKPPKEFLERFKSLLQKMIHQHLSSRTHGSEDS | 1.144 | 1663 |
| IL-21_5121 | V98E, T110D, A112P, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNPGRRQKHRLECP SCDSYEKKPPKEFLERFKSLLQKMIHQHLSSRTHGSEDS | 1.144 | 1664 |
| IL-21_5147 | V98E, P107V, A112P, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNPGRRQKHRLECP SCDSYEKKPPKEFLERFKSLLQKMIHQHLSSRTHGSEDS | 1.144 | 1665 |
| IL-21_5083 | V98E, A112P, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGRRQKHTLECP SCDSYEKKPPKEFLERFKSLLQKMIHQHLSSRTHGSEDS | 1.146 | 1666 |
| IL-21_5396 | N70G, P107V, R114Q, R115G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGQGQKHRLTCP SCDSYEKKPPKEFLERFKSLLQKMIHQHLSSRTHGSEDS | 1.146 | 1667 |
| IL-21_5822 | V98E, T110D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGRRQKHRLTCP SCDSYEKKPPKEFLERFKSLLQKMIHQHLSSRTHGSEDS | 1.148 | 1668 |
| IL-21_5309 | N70G, H118D, R119T, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRRQKDTLECP SCDSYEKKPPKEFLERFKSLLQKMIHQHLSSRTHGSEDS | 1.148 | 1669 |
| IL-21_6073 | H35F, I45T, V98E, R115G | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINESIKKLKRKPPSTNAGRGQKHRLTCP SCDSYEKKPPKEFLERFKSLLQKMIHQHLSSRTHGSEDS | 1.148 | 1670 |
| IL-21_4982 | T110D, A112P, R114G, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGGDQKHRLTCP SCDSYEKKPPKEFLERFKSLLQKMIHQHLSSRTHGSEDS | 1.148 | 1671 |
| IL-21_5331 | N70G, R114Q, R115D, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGQDQKHRLECP SCDSYEKKPPKEFLERFKSLLQKMIHQHLSSRTHGSEDS | 1.149 | 1672 |
| IL-21_5716 | N70G, R115D, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRDQKDRLTCP SCDSYEKKPPKEFLERFKSLLQKMIHQHLSSRTHGSEDS | 1.149 | 1673 |
| IL-21_6020 | H35F, N70G, R114G, R115G | MRSSPGNMERIVICLMVIFLGTLVHKSSSQGQDRFMIRMRQ LIDIVDQLKNYVNDLVPEFLPAPEDVETGCEWSAFSCFQKA QLKSANTGNNERIINVSIKKLKRKPPSTNAGGGQKHRLTCP SCDSYEKKPPKEFLERFKSLLQKMIHQHLSSRTHGSEDS | 1.149 | 1674 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_6409 | H35F, K81D | MRSSPGNMERIVICLMVIFLGTLVHKSSSQGQDRFMIRMRQ LIDIVDQLKNYVNDLVPEFLPAPEDVETNCEWSAFSCFQDA QLKSANTGNNERIINVSIKKLKRKPPSTNAGRRQKHRLTCP SCDSYEKKPPKEFLERFKSLLQKMIHQHLSSRTHGSEDS | 1.15 | 1675 |
| IL-21_5359 | N70G, T110D, R115D, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGRDQKHRLECP SCDSYEKKPPKEFLERFKSLLQKMIHQHLSSRTHGSEDS | 1.151 | 1676 |
| IL-21_5674 | K81D, A112P, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGRRQKHRLECP SCDSYEKKPPKEFLERFKSLLQKMIHQHLSSRTHGSEDS | 1.151 | 1677 |
| IL-21_5886 | I45T, V98E, P107V, R114G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKVPSTNAGGRQKHRLTCP SCDSYEKKPPKEFLERFKSLLQKMIHQHLSSRTHGSEDS | 1.151 | 1678 |
| IL-21_4953 | T110D, R114G, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGGRQKDTLTCP SCDSYEKKPPKEFLERFKSLLQKMIHQHLSSRTHGSEDS | 1.152 | 1679 |
| IL-21_4988 | P107V, H118D, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGRRQKDTLECP SCDSYEKKPPKEFLERFKSLLQKMIHQHLSSRTHGSEDS | 1.152 | 1680 |
| IL-21_6203 | H35I, I45T, R114Q, R115D | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKPPSTNAGQDQKHRLTCP SCDSYEKKPPKEFLERFKSLLQKMIHQHLSSRTHGSEDS | 1.153 | 1681 |
| IL-21_5446 | N70G, V98E, T110D, A112P | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSDNPGRRQKHRLTCP SCDSYEKKPPKEFLERFKSLLQKMIHQHLSSRTHGSEDS | 1.154 | 1682 |
| IL-21_6034 | H35F, N70G, P107V, R115D | MRSSPGNMERIVICLMVIFLGTLVHKSSSQGQDRFMIRMRQ LIDIVDQLKNYVNDLVPEFLPAPEDVETGCEWSAFSCFQKA QLKSANTGNNERIINVSIKKLKRKVPSTNAGRDQKHRLTCP SCDSYEKKPPKEFLERFKSLLQKMIHQHLSSRTHGSEDS | 1.154 | 1683 |
| IL-21_5031 | P107V, A112P, R114Q, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGQDQKHRLTCP SCDSYEKKPPKEFLERFKSLLQKMIHQHLSSRTHGSEDS | 1.155 | 1684 |
| IL-21_4946 | T110D, R115G, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRGQKDRLECP SCDSYEKKPPKEFLERFKSLLQKMIHQHLSSRTHGSEDS | 1.156 | 1685 |
| IL-21_6054 | H35F, I45T, R114G, R115G | MRSSPGNMERIVICLMVIFLGTLVHKSSSQGQDRFMIRMRQ LIDTVDQLKNYVNDLVPEFLPAPEDVETNCEWSAFSCFQKA QLKSANTGNNERIINVSIKKLKRKPPSTNAGGGQKHRLTCP SCDSYEKKPPKEFLERFKSLLQKMIHQHLSSRTHGSEDS | 1.157 | 1686 |
| IL-21_5358 | N70G, T110D, R115G, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGRGQKDRLTCP SCDSYEKKPPKEFLERFKSLLQKMIHQHLSSRTHGSEDS | 1.157 | 1687 |
| IL-21_5638 | V98E, T110D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSDNAGRRQKHRLECP SCDSYEKKPPKEFLERFKSLLQKMIHQHLSSRTHGSEDS | 1.161 | 1688 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5099 | V98E, A112P, R114Q, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGQRQKDRLTCP SCDSYEKKPPKEFLERFKSLLQKMIHQHLSSRTHGSEDS | 1.162 | 1689 |
| IL-21_4948 | T110D, R115D, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRDQKHTLECP SCDSYEKKPPKEFLERFKSLLQKMIHQHLSSRTHGSEDS | 1.162 | 1690 |
| IL-21_5380 | N70G, P107V, H118D, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGRRQKDRLECP SCDSYEKKPPKEFLERFKSLLQKMIHQHLSSRTHGSEDS | 1.162 | 1691 |
| IL-21_4933 | A112P, R114G, R115D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGGDQKHTLTCP SCDSYEKKPPKEFLERFKSLLQKMIHQHLSSRTHGSEDS | 1.163 | 1692 |
| IL-21_5354 | N70G, T110D, H118D, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGRRQKDRLECP SCDSYEKKPPKEFLERFKSLLQKMIHQHLSSRTHGSEDS | 1.166 | 1693 |
| IL-21_5738 | N70G, T110D, R115D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGRDQKHRLTCP SCDSYEKKPPKEFLERFKSLLQKMIHQHLSSRTHGSEDS | 1.167 | 1694 |
| IL-21_6056 | H35F, I45T, R114Q, R115G | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINVSIKKLKRKPPSTNAGQGQKHRLTCP SCDSYEKKPPKEFLERFKSLLQKMIHQHLSSRTHGSEDS | 1.168 | 1695 |
| IL-21_6219 | H35I, I45T, V98E, R115G | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINESIKKLKRKPPSTNAGRGQKHRLTCP SCDSYEKKPPKEFLERFKSLLQKMIHQHLSSRTHGSEDS | 1.169 | 1696 |
| IL-21_5148 | V98E, P107V, A112P, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNPGRRQKHTLTCP SCDSYEKKPPKEFLERFKSLLQKMIHQHLSSRTHGSEDS | 1.17 | 1697 |
| IL-21_5845 | N70G, K81D | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNAGRRQKHRLTCP SCDSYEKKPPKEFLERFKSLLQKMIHQHLSSRTHGSEDS | 1.17 | 1698 |
| IL-21_5919 | I45T, N70G, R114Q, R115D | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKPPSTNAGQDQKHRLTCP SCDSYEKKPPKEFLERFKSLLQKMIHQHLSSRTHGSEDS | 1.171 | 1699 |
| IL-21_4996 | P107V, R114G, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGGRQKDRLECP SCDSYEKKPPKEFLERFKSLLQKMIHQHLSSRTHGSEDS | 1.172 | 1700 |
| IL-21_6272 | I45T, K81D, R114Q | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKPPSTNAGQRQKHRLTCP SCDSYEKKPPKEFLERFKSLLQKMIHQHLSSRTHGSEDS | 1.174 | 1701 |
| IL-21_5432 | N70G, V98E, A112P, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNPGRRQKHRLECP SCDSYEKKPPKEFLERFKSLLQKMIHQHLSSRTHGSEDS | 1.175 | 1702 |
| IL-21_6111 | H35I, P107V, R114Q, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKVPSTNAGQGQKHRLTCP SCDSYEKKPPKEFLERFKSLLQKMIHQHLSSRTHGSEDS | 1.175 | 1703 |

TABLE 10-continued

IL-21 Combination Mutant Stabilized Variants

| Variant Name | Mutations | Amino Acid Sequence | Predicted Affinity | SEQ ID NO |
| --- | --- | --- | --- | --- |
| IL-21_4944 | T110D, H118D, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRRQKDTLECP SCDSYEKKPPKEFLERFKSLLQKMIHQHLSSRTHGSEDS | 1.18 | 1704 |
| IL-21_5925 | I45T, N70G, T110D, R115D | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKPPSDNAGRDQKHRLTCP SCDSYEKKPPKEFLERFKSLLQKMIHQHLSSRTHGSEDS | 1.183 | 1705 |
| IL-21_6230 | H35I, I45T, K81D, A112P | MRSSPGNMERIVICLMVIFLGTLVHKSSSQGQDRIMIRMRQ LIDTVDQLKNYVNDLVPEFLPAPEDVETNCEWSAFSCFQDA QLKSANTGNNERIINVSIKKLKRKPPSTNPGRRQKHRLTCP SCDSYEKKPPKEFLERFKSLLQKMIHQHLSSRTHGSEDS | 1.183 | 1706 |
| IL-21_4942 | A112P, R114Q, R115D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGQDQKHTLTCP SCDSYEKKPPKEFLERFKSLLQKMIHQHLSSRTHGSEDS | 1.184 | 1707 |
| IL-21_5917 | I45T, N70G, R114G, R115D | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKPPSTNAGGDQKHRLTCP SCDSYEKKPPKEFLERFKSLLQKMIHQHLSSRTHGSEDS | 1.184 | 1708 |
| IL-21_5655 | K81D, R119T, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRRQKHTLECP SCDSYEKKPPKEFLERFKSLLQKMIHQHLSSRTHGSEDS | 1.185 | 1709 |
| IL-21_5559 | T110D, R115D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRDQKHRLECP SCDSYEKKPPKEFLERFKSLLQKMIHQHLSSRTHGSEDS | 1.185 | 1710 |
| IL-21_5357 | N70G, T110D, R115G, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGRGQKHTLTCP SCDSYEKKPPKEFLERFKSLLQKMIHQHLSSRTHGSEDS | 1.185 | 1711 |
| IL-21_5390 | N70G, P107V, R114G, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGGRQKDRLTCP SCDSYEKKPPKEFLERFKSLLQKMIHQHLSSRTHGSEDS | 1.186 | 1712 |
| IL-21_5364 | N70G, T110D, R114G, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGGRQKDRLTCP SCDSYEKKPPKEFLERFKSLLQKMIHQHLSSRTHGSEDS | 1.187 | 1713 |
| IL-21_6112 | H35I, P107V, R114Q, R115D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKVPSTNAGQDQKHRLTCP SCDSYEKKPPKEFLERFKSLLQKMIHQHLSSRTHGSEDS | 1.187 | 1714 |
| IL-21_5833 | K81D, P107V | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGRRQKHRLTCP SCDSYEKKPPKEFLERFKSLLQKMIHQHLSSRTHGSEDS | 1.188 | 1715 |
| IL-21_5946 | I45T, N70G, K81D, A112P | MRSSPGNMERIVICLMVIFLGTLVHKSSSQGQDRHMIRMRQ LIDTVDQLKNYVNDLVPEFLPAPEDVETGCEWSAFSCFQDA QLKSANTGNNERIINVSIKKLKRKPPSTNPGRRQKHRLTCP SCDSYEKKPPKEFLERFKSLLQKMIHQHLSSRTHGSEDS | 1.19 | 1716 |
| IL-21_5055 | P107V, T110D, A112P, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNPGRDQKHRLTCP SCDSYEKKPPKEFLERFKSLLQKMIHQHLSSRTHGSEDS | 1.19 | 1717 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_6379 | H35I, N70G, V98E | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINESIKKLKRKPPSTNAGRRQKHRLTCP SCDSYEKKPPKEFLERFKSLLQKMIHQHLSSRTHGSEDS | 1.19 | 1718 |
| IL-21_5327 | N70G, R114Q, H118D, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGQRQKDTLTCP SCDSYEKKPPKEFLERFKSLLQKMIHQHLSSRTHGSEDS | 1.192 | 1719 |
| IL-21_5005 | P107V, R114Q, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGQRQKDRLECP SCDSYEKKPPKEFLERFKSLLQKMIHQHLSSRTHGSEDS | 1.193 | 1720 |
| IL-21_5476 | N70G, K81D, A112P, R119T | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNPGRRQKHTLTCP SCDSYEKKPPKEFLERFKSLLQKMIHQHLSSRTHGSEDS | 1.194 | 1721 |
| IL-21_6031 | H35F, N70G, T110D, R114Q | MRSSPGNMERIVICLMVIFLGTLVHKSSSQGQDREMIRMRQ LIDIVDQLKNYVNDLVPEFLPAPEDVETGCEWSAFSCFQKA QLKSANTGNNERIINVSIKKLKRKPPSDNAGQRQKHRLTCP SCDSYEKKPPKEFLERFKSLLQKMIHQHLSSRTHGSEDS | 1.194 | 1722 |
| IL-21_6232 | H35I, I45T, K81D, P107V | MRSSPGNMERIVICLMVIFLGTLVHKSSSQGQDRIMIRMRQ LIDTVDQLKNYVNDLVPEFLPAPEDVETNCEWSAFSCFQDA QLKSANTGNNERIINVSIKKLKRKVPSTNAGRRQKHRLTCP SCDSYEKKPPKEFLERFKSLLQKMIHQHLSSRTHGSEDS | 1.195 | 1723 |
| IL-21_5034 | P107V, T110D, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGRRQKDTLTCP SCDSYEKKPPKEFLERFKSLLQKMIHQHLSSRTHGSEDS | 1.195 | 1724 |
| IL-21_6370 | H35I, K81D, P107V | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKVPSTNAGRRQKHRLTCP SCDSYEKKPPKEFLERFKSLLQKMIHQHLSSRTHGSEDS | 1.196 | 1725 |
| IL-21_5008 | P107V, R114Q, R115G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGQGQKHTLTCP SCDSYEKKPPKEFLERFKSLLQKMIHQHLSSRTHGSEDS | 1.196 | 1726 |
| IL-21_4916 | R114Q, R115D, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGQDQKHTLECP SCDSYEKKPPKEFLERFKSLLQKMIHQHLSSRTHGSEDS | 1.199 | 1727 |
| IL-21_5007 | P107V, R114Q, R115G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGQGQKHRLECP SCDSYEKKPPKEFLERFKSLLQKMIHQHLSSRTHGSEDS | 1.201 | 1728 |
| IL-21_6189 | H35I, N70G, V98E, A112P | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINESIKKLKRKPPSTNPGRRQKHRLTCP SCDSYEKKPPKEFLERFKSLLQKMIHQHLSSRTHGSEDS | 1.201 | 1729 |
| IL-21_5352 | N70G, A112P, R114Q, R115D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGQDQKHRLTCP SCDSYEKKPPKEFLERFKSLLQKMIHQHLSSRTHGSEDS | 1.201 | 1730 |
| IL-21_6030 | H35F, N70G, T110D, R114G | MRSSPGNMERIVICLMVIFLGTLVHKSSSQGQDRFMIRMRQ LIDIVDQLKNYVNDLVPEFLPAPEDVETGCEWSAFSCFQKA QLKSANTGNNERIINVSIKKLKRKPPSDNAGGRQKHRLTCP SCDSYEKKPPKEFLERFKSLLQKMIHQHLSSRTHGSEDS | 1.202 | 1731 |
| IL-21_5612 | V98E, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRRQKHTLECP SCDSYEKKPPKEFLERFKSLLQKMIHQHLSSRTHGSEDS | 1.203 | 1732 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5964 | H35F, P107V, R114Q, R115G | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKVPSTNAGQGQKHRLTCP SCDSYEKKPPKEFLERFKSLLQKMIHQHLSSRTHGSEDS | 1.204 | 1733 |
| IL-21_6103 | H35I, T110D, R114Q, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSDNAGQGQKHRLTCP SCDSYEKKPPKEFLERFKSLLQKMIHQHLSSRTHGSEDS | 1.204 | 1734 |
| IL-21_5320 | N70G, R114G, R115G, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGGGQKHTLTCP SCDSYEKKPPKEFLERFKSLLQKMIHQHLSSRTHGSEDS | 1.205 | 1735 |
| IL-21_5514 | R115D, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGRDQKDRLECP SCDSYEKKPPKEFLERFKSLLQKMIHQHLSSRTHGSEDS | 1.205 | 1736 |
| IL-21_5351 | N70G, A112P, R114Q, R115G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGQGQKHRLTCP SCDSYEKKPPKEFLERFKSLLQKMIHQHLSSRTHGSEDS | 1.205 | 1737 |
| IL-21_4958 | T110D, R114G, R115D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGGDQKHTLTCP SCDSYEKKPPKEFLERFKSLLQKMIHQHLSSRTHGSEDS | 1.206 | 1738 |
| IL-21_5381 | N70G, P107V, H118D, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGRRQKDTLTCP SCDSYEKKPPKEFLERFKSLLQKMIHQHLSSRTHGSEDS | 1.207 | 1739 |
| IL-21_5532 | R114Q, R115D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGQDQKHTLTCP SCDSYEKKPPKEFLERFKSLLQKMIHQHLSSRTHGSEDS | 1.207 | 1740 |
| IL-21_5967 | H35F, P107V, A112P, R115D | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKVPSTNPGRDQKHRLTCP SCDSYEKKPPKEFLERFKSLLQKMIHQHLSSRTHGSEDS | 1.207 | 1741 |
| IL-21_5375 | N70G, T110D, A112P, R115G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNPGRGQKHRLTCP SCDSYEKKPPKEFLERFKSLLQKMIHQHLSSRTHGSEDS | 1.207 | 1742 |
| IL-21_4908 | R114G, R115G, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGGGQKDTLTCP SCDSYEKKPPKEFLERFKSLLQKMIHQHLSSRTHGSEDS | 1.208 | 1743 |
| IL-21_5826 | K81D, H118D | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRRQKDRLTCP SCDSYEKKPPKEFLERFKSLLQKMIHQHLSSRTHGSEDS | 1.209 | 1744 |
| IL-21_5311 | N70G, R115G, H118D, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRGQKDRLECP SCDSYEKKPPKEFLERFKSLLQKMIHQHLSSRTHGSEDS | 1.209 | 1745 |
| IL-21_4912 | R114Q, H118D, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGQRQKDTLECP SCDSYEKKPPKEFLERFKSLLQKMIHQHLSSRTHGSEDS | 1.212 | 1746 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_4999 | P107V, R114G, R115G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGGGQKHTLTCP SCDSYEKKPPKEFLERFKSLLQKMIHQHLSSRTHGSEDS | 1.213 | 1747 |
| IL-21_5689 | K81D, P107V, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNAGRRQKHRLECP SCDSYEKKPPKEFLERFKSLLQKMIHQHLSSRTHGSEDS | 1.213 | 1748 |
| IL-21_6269 | I45T, K81D, R115G | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKPPSTNAGRGQKHRLTCP SCDSYEKKPPKEFLERFKSLLQKMIHQHLSSRTHGSEDS | 1.213 | 1749 |
| IL-21_5410 | N70G, P107V, T110D, R114G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSDNAGGRQKHRLTCP SCDSYEKKPPKEFLERFKSLLQKMIHQHLSSRTHGSEDS | 1.213 | 1750 |
| IL-21_6078 | H35F, I45T, V98E, T110D | MRSSPGNMERIVICLMVIFLGTLVHKSSSQGQDRFMIRMRQ LIDTVDQLKNYVNDLVPEFLPAPEDVETNCEWSAFSCFQKA QLKSANTGNNERIINESIKKLKRKPPSDNAGRRQKHRLTCP SCDSYEKKPPKEFLERFKSLLQKMIHQHLSSRTHGSEDS | 1.214 | 1751 |
| IL-21_5859 | I45T, P107V, R114G, R115D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKVPSTNAGGDQKHRLTCP SCDSYEKKPPKEFLERFKSLLQKMIHQHLSSRTHGSEDS | 1.218 | 1752 |
| IL-21_4961 | T110D, R114Q, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGQRQKDRLECP SCDSYEKKPPKEFLERFKSLLQKMIHQHLSSRTHGSEDS | 1.222 | 1753 |
| IL-21_6341 | H35I, R114Q, R115D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSTNAGQDQKHRLTCP SCDSYEKKPPKEFLERFKSLLQKMIHQHLSSRTHGSEDS | 1.222 | 1754 |
| IL-21_6176 | H35I, N70G, T110D, R115D | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKPPSDNAGRDQKHRLTCP SCDSYEKKPPKEFLERFKSLLQKMIHQHLSSRTHGSEDS | 1.222 | 1755 |
| IL-21_6180 | H35I, N70G, P107V, R115D | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKVPSTNAGRDQKHRLTCP SCDSYEKKPPKEFLERFKSLLQKMIHQHLSSRTHGSEDS | 1.223 | 1756 |
| IL-21_5719 | N70G, R114G, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGGRQKDRLTCP SCDSYEKKPPKEFLERFKSLLQKMIHQHLSSRTHGSEDS | 1.224 | 1757 |
| IL-21_5020 | P107V, A112P, R115D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGRDQKHTLTCP SCDSYEKKPPKEFLERFKSLLQKMIHQHLSSRTHGSEDS | 1.225 | 1758 |
| IL-21_6368 | H35I, K81D, A112P | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSTNPGRRQKHRLTCP SCDSYEKKPPKEFLERFKSLLQKMIHQHLSSRTHGSEDS | 1.226 | 1759 |
| IL-21_5632 | V98E, A112P, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGRRQKHTLTCP SCDSYEKKPPKEFLERFKSLLQKMIHQHLSSRTHGSEDS | 1.226 | 1760 |
| IL-21_5384 | N70G, P107V, R115G, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGRGQKDRLTCP SCDSYEKKPPKEFLERFKSLLQKMIHQHLSSRTHGSEDS | 1.226 | 1761 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_6178 | H35I, N70G, T110D, R114Q | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKPPSDNAGQRQKHRLTCP SCDSYEKKPPKEFLERFKSLLQKMIHQHLSSRTHGSEDS | 1.228 | 1762 |
| IL-21_6262 | I45T, V98E, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKPPSTNAGRGQKHRLTCP SCDSYEKKPPKEFLERFKSLLQKMIHQHLSSRTHGSEDS | 1.228 | 1763 |
| IL-21_4931 | A112P, R114G, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGGGQKDRLTCP SCDSYEKKPPKEFLERFKSLLQKMIHQHLSSRTHGSEDS | 1.229 | 1764 |
| IL-21_6347 | H35I, T110D, R115D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSDNAGRDQKHRLTCP SCDSYEKKPPKEFLERFKSLLQKMIHQHLSSRTHGSEDS | 1.23 | 1765 |
| IL-21_5512 | R115G, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGRGQKDTLTCP SCDSYEKKPPKEFLERFKSLLQKMIHQHLSSRTHGSEDS | 1.233 | 1766 |
| IL-21_6068 | H35F, I45T, P107V, R115D | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINVSIKKLKRKVPSTNAGRDQKHRLTCP SCDSYEKKPPKEFLERFKSLLQKMIHQHLSSRTHGSEDS | 1.235 | 1767 |
| IL-21_5680 | K81D, A112P, R114Q | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGQRQKHRLTCP SCDSYEKKPPKEFLERFKSLLQKMIHQHLSSRTHGSEDS | 1.235 | 1768 |
| IL-21_6117 | H35I, P107V, T110D, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKVPSDNAGRGQKHRLTCP SCDSYEKKPPKEFLERFKSLLQKMIHQHLSSRTHGSEDS | 1.236 | 1769 |
| IL-21_6114 | H35I, P107V, A112P, R115D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKVPSTNPGRDQKHRLTCP SCDSYEKKPPKEFLERFKSLLQKMIHQHLSSRTHGSEDS | 1.238 | 1770 |
| IL-21_6373 | H35I, N70G, R115D | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKPPSTNAGRDQKHRLTCP SCDSYEKKPPKEFLERFKSLLQKMIHQHLSSRTHGSEDS | 1.239 | 1771 |
| IL-21_5004 | P107V, R114Q, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGQRQKHTLECP SCDSYEKKPPKEFLERFKSLLQKMIHQHLSSRTHGSEDS | 1.239 | 1772 |
| IL-21_5586 | P107V, R115D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGRDQKHTLTCP SCDSYEKKPPKEFLERFKSLLQKMIHQHLSSRTHGSEDS | 1.239 | 1773 |
| IL-21_5368 | N70G, T110D, R114Q, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGQRQKHTLTCP SCDSYEKKPPKEFLERFKSLLQKMIHQHLSSRTHGSEDS | 1.239 | 1774 |
| IL-21_5036 | P107V, T110D, R115G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGRGQKHTLTCP SCDSYEKKPPKEFLERFKSLLQKMIHQHLSSRTHGSEDS | 1.24 | 1775 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5992 | H35F, V98E, P107V, A112P | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINESIKKLKRKVPSTNPGRRQKHRLTCP SCDSYEKKPPKEFLERFKSLLQKMIHQHLSSRTHGSEDS | 1.241 | 1776 |
| IL-21_6100 | H35I, A112P, R114Q, R115D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSTNPGQDQKHRLTCP SCDSYEKKPPKEFLERFKSLLQKMIHQHLSSRTHGSEDS | 1.242 | 1777 |
| IL-21_4915 | R114Q, R115G, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGQGQKDTLTCP SCDSYEKKPPKEFLERFKSLLQKMIHQHLSSRTHGSEDS | 1.242 | 1778 |
| IL-21_5326 | N70G, R114Q, H118D, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGQRQKDRLECP SCDSYEKKPPKEFLERFKSLLQKMIHQHLSSRTHGSEDS | 1.244 | 1779 |
| IL-21_5033 | P107V, T110D, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGRRQKDRLECP SCDSYEKKPPKEFLERFKSLLQKMIHQHLSSRTHGSEDS | 1.244 | 1780 |
| IL-21_6120 | H35I, P107V, T110D, R114Q | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKVPSDNAGQRQKHRLTCP SCDSYEKKPPKEFLERFKSLLQKMIHQHLSSRTHGSEDS | 1.245 | 1781 |
| IL-21_5411 | N70G, P107V, T110D, R114Q | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSDNAGQRQKHRLTCP SCDSYEKKPPKEFLERFKSLLQKMIHQHLSSRTHGSEDS | 1.245 | 1782 |
| IL-21_5365 | N70G, T110D, R114G, R115G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGGGQKHRLTCP SCDSYEKKPPKEFLERFKSLLQKMIHQHLSSRTHGSEDS | 1.247 | 1783 |
| IL-21_5363 | N70G, T110D, R114G, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGGRQKHTLTCP SCDSYEKKPPKEFLERFKSLLQKMIHQHLSSRTHGSEDS | 1.247 | 1784 |
| IL-21_5515 | R115D, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGRDQKDTLTCP SCDSYEKKPPKEFLERFKSLLQKMIHQHLSSRTHGSEDS | 1.251 | 1785 |
| IL-21_5825 | K81D, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRRQKHTLTCP SCDSYEKKPPKEFLERFKSLLQKMIHQHLSSRTHGSEDS | 1.251 | 1786 |
| IL-21_4989 | P107V, R115G, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGRGQKHTLECP SCDSYEKKPPKEFLERFKSLLQKMIHQHLSSRTHGSEDS | 1.252 | 1787 |
| IL-21_6308 | H35F, V98E, A112P | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINESIKKLKRKPPSTNPGRRQKHRLTCP SCDSYEKKPPKEFLERFKSLLQKMIHQHLSSRTHGSEDS | 1.253 | 1788 |
| IL-21_5675 | K81D, A112P, R119T | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGRRQKHTLTCP SCDSYEKKPPKEFLERFKSLLQKMIHQHLSSRTHGSEDS | 1.253 | 1789 |
| IL-21_5962 | H35F, P107V, R114G, R115G | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKVPSTNAGGGQKHRLTCP SCDSYEKKPPKEFLERFKSLLQKMIHQHLSSRTHGSEDS | 1.254 | 1790 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5049 | P107V, T110D, R114Q, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGQGQKHRLTCP SCDSYEKKPPKEFLERFKSLLQKMIHQHLSSRTHGSEDS | 1.256 | 1791 |
| IL-21_5454 | N70G, V98E, P107V, A112P | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKVPSTNPGRRQKHRLTCP SCDSYEKKPPKEFLERFKSLLQKMIHQHLSSRTHGSEDS | 1.256 | 1792 |
| IL-21_4903 | R115G, H118D, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGRGQKDTLECP SCDSYEKKPPKEFLERFKSLLQKMIHQHLSSRTHGSEDS | 1.256 | 1793 |
| IL-21_5696 | K81D, P107V, A112P | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKVPSTNPGRRQKHRLTCP SCDSYEKKPPKEFLERFKSLLQKMIHQHLSSRTHGSEDS | 1.257 | 1794 |
| IL-21_6408 | H35F, V98E | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINESIKKLKRKPPSTNAGRRQKHRLTCP SCDSYEKKPPKEFLERFKSLLQKMIHQHLSSRTHGSEDS | 1.258 | 1795 |
| IL-21_4962 | T110D, R114Q, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRQKDTLTCP SCDSYEKKPPKEFLERFKSLLQKMIHQHLSSRTHGSEDS | 1.258 | 1796 |
| IL-21_4990 | P107V, R115G, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGRGQKDRLECP SCDSYEKKPPKEFLERFKSLLQKMIHQHLSSRTHGSEDS | 1.261 | 1797 |
| IL-21_6134 | H35I, V98E, T110D, A112P | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKPPSDNPGRRQKHRLTCP SCDSYEKKPPKEFLERFKSLLQKMIHQHLSSRTHGSEDS | 1.262 | 1798 |
| IL-21_5524 | R114G, R115D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGGDQKDRLTCP SCDSYEKKPPKEFLERFKSLLQKMIHQHLSSRTHGSEDS | 1.263 | 1799 |
| IL-21_5746 | N70G, P107V, R115D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGRDQKHRLTCP SCDSYEKKPPKEFLERFKSLLQKMIHQHLSSRTHGSEDS | 1.264 | 1800 |
| IL-21_5328 | N70G, R114Q, R115G, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGQGQKHRLECP SCDSYEKKPPKEFLERFKSLLQKMIHQHLSSRTHGSEDS | 1.264 | 1801 |
| IL-21_5646 | V98E, P107V, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGRRQKHRLECP SCDSYEKKPPKEFLERFKSLLQKMIHQHLSSRTHGSEDS | 1.265 | 1802 |
| IL-21_4947 | T110D, R115G, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRGQKDTLTCP SCDSYEKKPPKEFLERFKSLLQKMIHQHLSSRTHGSEDS | 1.265 | 1803 |
| IL-21_5561 | T110D, R115D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRDQKDRLTCP SCDSYEKKPPKEFLERFKSLLQKMIHQHLSSRTHGSEDS | 1.267 | 1804 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_4954 | T110D, R114G, R115G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGGGQKHRLECP SCDSYEKKPPKEFLERFKSLLQKMIHQHLSSRTHGSEDS | 1.268 | 1805 |
| IL-21_5907 | I45T, K81D, P107V, A112P | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKVPSTNPGRRQKHRLTCP SCDSYEKKPPKEFLERFKSLLQKMIHQHLSSRTHGSEDS | 1.27 | 1806 |
| IL-21_6296 | H35F, T110D, R114Q | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKPPSDNAGQRQKHRLTCP SCDSYEKKPPKEFLERFKSLLQKMIHQHLSSRTHGSEDS | 1.271 | 1807 |
| IL-21_4913 | R114Q, R115G, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGQGQKHTLECP SCDSYEKKPPKEFLERFKSLLQKMIHQHLSSRTHGSEDS | 1.274 | 1808 |
| IL-21_6295 | H35F, T110D, R114G | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKPPSDNAGGRQKHRLTCP SCDSYEKKPPKEFLERFKSLLQKMIHQHLSSRTHGSEDS | 1.274 | 1809 |
| IL-21_5714 | N70G, R115D, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRDQKHRLECP SCDSYEKKPPKEFLERFKSLLQKMIHQHLSSRTHGSEDS | 1.275 | 1810 |
| IL-21_5317 | N70G, R114G, H118D, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGGRQKDRLECP SCDSYEKKPPKEFLERFKSLLQKMIHQHLSSRTHGSEDS | 1.275 | 1811 |
| IL-21_6201 | H35I, I45T, R114G, R115D | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKPPSTNAGGDQKHRLTCP SCDSYEKKPPKEFLERFKSLLQKMIHQHLSSRTHGSEDS | 1.277 | 1812 |
| IL-21_5376 | N70G, T110D, A112P, R115D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNPGRDQKHRLTCP SCDSYEKKPPKEFLERFKSLLQKMIHQHLSSRTHGSEDS | 1.278 | 1813 |
| IL-21_4955 | T110D, R114G, R115G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGGGQKHTLTCP SCDSYEKKPPKEFLERFKSLLQKMIHQHLSSRTHGSEDS | 1.278 | 1814 |
| IL-21_4956 | T110D, R114G, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGGGQKDRLTCP SCDSYEKKPPKEFLERFKSLLQKMIHQHLSSRTHGSEDS | 1.28 | 1815 |
| IL-21_4907 | R114G, R115G, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGGGQKDRLECP SCDSYEKKPPKEFLERFKSLLQKMIHQHLSSRTHGSEDS | 1.281 | 1816 |
| IL-21_5715 | N70G, R115D, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRDQKHTLTCP SCDSYEKKPPKEFLERFKSLLQKMIHQHLSSRTHGSEDS | 1.282 | 1817 |
| IL-21_6275 | I45T, K81D, P107V | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKVPSTNAGRRQKHRLTCP SCDSYEKKPPKEFLERFKSLLQKMIHQHLSSRTHGSEDS | 1.283 | 1818 |
| IL-21_5768 | N70G, K81D, A112P | MRSSPGNMERIVICLMVIFLGTLVHKSSSQGQDRHMIRMRQ LIDIVDQLKNYVNDLVPEFLPAPEDVETGCEWSAFSCFQDA QLKSANTGNNERIINVSIKKLKRKPPSTNPGRRQKHRLTCP SCDSYEKKPPKEFLERFKSLLQKMIHQHLSSRTHGSEDS | 1.285 | 1819 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5523 | R114G, R115D, R119T | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGDQKHTLTCPSCDSYEKKPPKEFLERFKSLLQKMIHQHLSSRTHGSEDS | 1.286 | 1820 |
| IL-21_6101 | H35I, T110D, R114G, R115G | MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSDNAGGGQKHRLTCPSCDSYEKKPPKEFLERFKSLLQKMIHQHLSSRTHGSEDS | 1.289 | 1821 |
| IL-21_5595 | P107V, R114Q, H118D | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGORQKDRLTCPSCDSYEKKPPKEFLERFKSLLQKMIHQHLSSRTHGSEDS | 1.291 | 1822 |
| IL-21_4934 | A112P, R114G, R115D, H118D | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGGDQKDRLTCPSCDSYEKKPPKEFLERFKSLLQKMIHQHLSSRTHGSEDS | 1.294 | 1823 |
| IL-21_5533 | R114Q, R115D, H118D | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGDQKDRLTCPSCDSYEKKPPKEFLERFKSLLQKMIHQHLSSRTHGSEDS | 1.295 | 1824 |
| IL-21_5407 | N70G, P107V, T110D, H118D | MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSDNAGRRQKDRLTCPSCDSYEKKPPKEFLERFKSLLQKMIHQHLSSRTHGSEDS | 1.296 | 1825 |
| IL-21_6267 | I45T, V98E, T110D | MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSDNAGRRQKHRLTCPSCDSYEKKPPKEFLERFKSLLQKMIHQHLSSRTHGSEDS | 1.298 | 1826 |
| IL-21_5952 | H35F, A112P, R114Q, R115G | MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNPGQGQKHRLTCPSCDSYEKKPPKEFLERFKSLLQKMIHQHLSSRTHGSEDS | 1.299 | 1827 |
| IL-21_6089 | H35F, I45T, N70G, R115D | MRSSPGNMERIVICLMVIFLGTLVHKSSSQGQDREMIRMRQLIDTVDQLKNYVNDLVPEFLPAPEDVETGCEWSAFSCFQKAQLKSANTGNNERIINVSIKKLKRKPPSTNAGRDQKHRLTCPSCDSYEKKPPKEFLERFKSLLQKMIHQHLSSRTHGSEDS | 1.3 | 1828 |
| IL-21_5720 | N70G, R114G, R115G | MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGGGQKHRLTCPSCDSYEKKPPKEFLERFKSLLQKMIHQHLSSRTHGSEDS | 1.3 | 1829 |
| IL-21_5725 | N70G, R114Q, R115G | MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGQGQKHRLTCPSCDSYEKKPPKEFLERFKSLLQKMIHQHLSSRTHGSEDS | 1.301 | 1830 |
| IL-21_5889 | I45T, V98E, P107V, T110D | MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKVPSDNAGRRQKHRLTCPSCDSYEKKPPKEFLERFKSLLQKMIHQHLSSRTHGSEDS | 1.301 | 1831 |
| IL-21_5591 | P107V, R114G, R115G | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGGGQKHRLTCPSCDSYEKKPPKEFLERFKSLLQKMIHQHLSSRTHGSEDS | 1.303 | 1832 |
| IL-21_4998 | P107V, R114G, R115G, T121E | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGGGQKHRLECPSCDSYEKKPPKEFLERFKSLLQKMIHQHLSSRTHGSEDS | 1.303 | 1833 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5015 | P107V, A112P, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGRRQKDTLTCP SCDSYEKKPPKEFLERFKSLLQKMIHQHLSSRTHGSEDS | 1.304 | 1834 |
| IL-21_6098 | H35I, A112P, R114G, R115D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSTNPGGDQKHRLTCP SCDSYEKKPPKEFLERFKSLLQKMIHQHLSSRTHGSEDS | 1.304 | 1835 |
| IL-21_5801 | T110D, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRDQKHRLTCP SCDSYEKKPPKEFLERFKSLLQKMIHQHLSSRTHGSEDS | 1.304 | 1836 |
| IL-21_6326 | H35F, N70G, V98E | MRSSPGNMERIVICLMVIFLGTLVHKSSSQGQDRFMIRMRQ LIDIVDQLKNYVNDLVPEFLPAPEDVETGCEWSAFSCFQKA QLKSANTGNNERIINESIKKLKRKPPSTNAGRRQKHRLTCP SCDSYEKKPPKEFLERFKSLLQKMIHQHLSSRTHGSEDS | 1.304 | 1837 |
| IL-21_5335 | N70G, A112P, H118D, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGRRQKDRLECP SCDSYEKKPPKEFLERFKSLLQKMIHQHLSSRTHGSEDS | 1.305 | 1838 |
| IL-21_6102 | H35I, T110D, R114G, R115D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSDNAGGDQKHRLTCP SCDSYEKKPPKEFLERFKSLLQKMIHQHLSSRTHGSEDS | 1.305 | 1839 |
| IL-21_4923 | A112P, R115D, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRDQKHTLECP SCDSYEKKPPKEFLERFKSLLQKMIHQHLSSRTHGSEDS | 1.306 | 1840 |
| IL-21_6413 | H35I, R115D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSTNAGRDQKHRLTCP SCDSYEKKPPKEFLERFKSLLQKMIHQHLSSRTHGSEDS | 1.306 | 1841 |
| IL-21_5902 | I45T, K81D, T110D, A112P | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKPPSDNPGRRQKHRLTCP SCDSYEKKPPKEFLERFKSLLQKMIHQHLSSRTHGSEDS | 1.306 | 1842 |
| IL-21_5731 | N70G, A112P, R115D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGRDQKHRLTCP SCDSYEKKPPKEFLERFKSLLQKMIHQHLSSRTHGSEDS | 1.307 | 1843 |
| IL-21_6320 | H35F, N70G, R115D | MRSSPGNMERIVICLMVIFLGTLVHKSSSQGQDRFMIRMRQ LIDIVDQLKNYVNDLVPEFLPAPEDVETGCEWSAFSCFQKA QLKSANTGNNERIINVSIKKLKRKPPSTNAGRDQKHRLTCP SCDSYEKKPPKEFLERFKSLLQKMIHQHLSSRTHGSEDS | 1.307 | 1844 |
| IL-21_6271 | I45T, K81D, R114G | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKPPSTNAGGRQKHRLTCP SCDSYEKKPPKEFLERFKSLLQKMIHQHLSSRTHGSEDS | 1.308 | 1845 |
| IL-21_5047 | P107V, T110D, R114Q, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGQRQKHTLTCP SCDSYEKKPPKEFLERFKSLLQKMIHQHLSSRTHGSEDS | 1.309 | 1846 |
| IL-21_5861 | I45T, P107V, R114Q, R115D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKVPSTNAGQDQKHRLTCP SCDSYEKKPPKEFLERFKSLLQKMIHQHLSSRTHGSEDS | 1.309 | 1847 |
| IL-21_5310 | N70G, R115G, R119T, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRGQKHTLECP SCDSYEKKPPKEFLERFKSLLQKMIHQHLSSRTHGSEDS | 1.311 | 1848 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5530 | R114Q, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGQGQKDRLTCP SCDSYEKKPPKEFLERFKSLLQKMIHQHLSSRTHGSEDS | 1.311 | 1849 |
| IL-21_6106 | H35I, T110D, A112P, R115D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSDNPGRDQKHRLTCP SCDSYEKKPPKEFLERFKSLLQKMIHQHLSSRTHGSEDS | 1.313 | 1850 |
| IL-21_4964 | T110D, R114Q, R115G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGQGQKHTLTCP SCDSYEKKPPKEFLERFKSLLQKMIHQHLSSRTHGSEDS | 1.313 | 1851 |
| IL-21_5402 | N70G, P107V, A112P, R115D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNPGRDQKHRLTCP SCDSYEKKPPKEFLERFKSLLQKMIHQHLSSRTHGSEDS | 1.315 | 1852 |
| IL-21_6284 | I45T, N70G, K81D | MRSSPGNMERIVICLMVIFLGTLVHKSSSQGQDRHMIRMRQ LIDTVDQLKNYVNDLVPEFLPAPEDVETGCEWSAFSCFQDA QLKSANTGNNERIINVSIKKLKRKPPSTNAGRRQKHRLTCP SCDSYEKKPPKEFLERFKSLLQKMIHQHLSSRTHGSEDS | 1.319 | 1853 |
| IL-21_6336 | H35F, I45T, K81D | MRSSPGNMERIVICLMVIFLGTLVHKSSSQGQDREMIRMRQ LIDTVDQLKNYVNDLVPEFLPAPEDVETNCEWSAFSCFQDA QLKSANTGNNERIINVSIKKLKRKPPSTNAGRRQKHRLTCP SCDSYEKKPPKEFLERFKSLLQKMIHQHLSSRTHGSEDS | 1.32 | 1854 |
| IL-21_5339 | N70G, A112P, R115G, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGRGQKDRLTCP SCDSYEKKPPKEFLERFKSLLQKMIHQHLSSRTHGSEDS | 1.32 | 1855 |
| IL-21_5758 | N70G, V98E, A112P | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNPGRRQKHRLTCP SCDSYEKKPPKEFLERFKSLLQKMIHQHLSSRTHGSEDS | 1.321 | 1856 |
| IL-21_5815 | V98E, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRRQKHTLTCP SCDSYEKKPPKEFLERFKSLLQKMIHQHLSSRTHGSEDS | 1.324 | 1857 |
| IL-21_4987 | T110D, A112P, R114Q, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGQDQKHRLTCP SCDSYEKKPPKEFLERFKSLLQKMIHQHLSSRTHGSEDS | 1.324 | 1858 |
| IL-21_6274 | I45T, K81D, T110D | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKPPSDNAGRRQKHRLTCP SCDSYEKKPPKEFLERFKSLLQKMIHQHLSSRTHGSEDS | 1.324 | 1859 |
| IL-21_5737 | N70G, T110D, R115G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGRGQKHRLTCP SCDSYEKKPPKEFLERFKSLLQKMIHQHLSSRTHGSEDS | 1.324 | 1860 |
| IL-21_6172 | H35I, N70G, A112P, R115D | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKPPSTNPGRDQKHRLTCP SCDSYEKKPPKEFLERFKSLLQKMIHQHLSSRTHGSEDS | 1.324 | 1861 |
| IL-21_5362 | N70G, T110D, R114G, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGGRQKHRLECP SCDSYEKKPPKEFLERFKSLLQKMIHQHLSSRTHGSEDS | 1.327 | 1862 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5374 | N70G, T110D, A112P, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNPGRRQKDRLTCP SCDSYEKKPPKEFLERFKSLLQKMIHQHLSSRTHGSEDS | 1.327 | 1863 |
| IL-21_5631 | V98E, A112P, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGRRQKHRLECP SCDSYEKKPPKEFLERFKSLLQKMIHQHLSSRTHGSEDS | 1.328 | 1864 |
| IL-21_6202 | H35I, I45T, R114Q, R115G | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKPPSTNAGQGQKHRLTCP SCDSYEKKPPKEFLERFKSLLQKMIHQHLSSRTHGSEDS | 1.328 | 1865 |
| IL-21_5408 | N70G, P107V, T110D, R115G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSDNAGRGQKHRLTCP SCDSYEKKPPKEFLERFKSLLQKMIHQHLSSRTHGSEDS | 1.328 | 1866 |
| IL-21_6287 | H35F, R114Q, R115G | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKPPSTNAGQGQKHRLTCP SCDSYEKKPPKEFLERFKSLLQKMIHQHLSSRTHGSEDS | 1.329 | 1867 |
| IL-21_5313 | N70G, R115D, R119T, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRDQKHTLECP SCDSYEKKPPKEFLERFKSLLQKMIHQHLSSRTHGSEDS | 1.333 | 1868 |
| IL-21_6095 | H35F, I45T, N70G, V98E | MRSSPGNMERIVICLMVIFLGTLVHKSSSQGQDREMIRMRQ LIDTVDQLKNYVNDLVPEFLPAPEDVETGCEWSAFSCFQKA QLKSANTGNNERIINESIKKLKRKPPSTNAGRRQKHRLTCP SCDSYEKKPPKEFLERFKSLLQKMIHQHLSSRTHGSEDS | 1.334 | 1869 |
| IL-21_5019 | P107V, A112P, R115D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGRDQKHRLECP SCDSYEKKPPKEFLERFKSLLQKMIHQHLSSRTHGSEDS | 1.334 | 1870 |
| IL-21_6361 | H35I, V98E, A112P | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKPPSTNPGRRQKHRLTCP SCDSYEKKPPKEFLERFKSLLQKMIHQHLSSRTHGSEDS | 1.335 | 1871 |
| IL-21_5884 | I45T, V98E, P017V, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKVPSTNAGRGQKHRLTCP SCDSYEKKPPKEFLERFKSLLQKMIHQHLSSRTHGSEDS | 1.336 | 1872 |
| IL-21_6293 | H35F, T110D, R115G | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKPPSDNAGRGQKHRLTCP SCDSYEKKPPKEFLERFKSLLQKMIHQHLSSRTHGSEDS | 1.336 | 1873 |
| IL-21_5319 | N70G, R114G, R115G, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGGGQKHRLECP SCDSYEKKPPKEFLERFKSLLQKMIHQHLSSRTHGSEDS | 1.337 | 1874 |
| IL-21_4995 | P107V, R114G, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGGRQKHTLECP SCDSYEKKPPKEFLERFKSLLQKMIHQHLSSRTHGSEDS | 1.337 | 1875 |
| IL-21_5513 | R115D, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGRDQKHTLECP SCDSYEKKPPKEFLERFKSLLQKMIHQHLSSRTHGSEDS | 1.338 | 1876 |
| IL-21_4940 | A112P, R114Q, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGQGQKDRLTCP SCDSYEKKPPKEFLERFKSLLQKMIHQHLSSRTHGSEDS | 1.34 | 1877 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_4951 | T110D, R114G, R119T, T121E | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGGRQKHTLECPSCDSYEKKPPKEFLERFKSLLQKMIHQHLSSRTHGSEDS | 1.341 | 1878 |
| IL-21_6246 | I45T, R114Q, R115D | MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSTNAGQDQKHRLTCPSCDSYEKKPPKEFLERFKSLLQKMIHQHLSSRTHGSEDS | 1.343 | 1879 |
| IL-21_5389 | N70G, P107V, R114G, R119T | MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGGRQKHTLTCPSCDSYEKKPPKEFLERFKSLLQKMIHQHLSSRTHGSEDS | 1.346 | 1880 |
| IL-21_5869 | I45T, P107V, T110D, R114Q | MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSDNAGQRQKHRLTCPSCDSYEKKPPKEFLERFKSLLQKMIHQHLSSRTHGSEDS | 1.346 | 1881 |
| IL-21_5316 | N70G, R114G, R119T, T121E | MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGGRQKHTLECPSCDSYEKKPPKEFLERFKSLLQKMIHQHLSSRTHGSEDS | 1.346 | 1882 |
| IL-21_5367 | N70G, T110D, R114Q, T121E | MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGQRQKHRLECPSCDSYEKKPPKEFLERFKSLLQKMIHQHLSSRTHGSEDS | 1.347 | 1883 |
| IL-21_5585 | P107V, R115D, T121E | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRDQKHRLECPSCDSYEKKPPKEFLERFKSLLQKMIHQHLSSRTHGSEDS | 1.349 | 1884 |
| IL-21_5935 | I45T, N70G, V98E, R115G | MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINESIKKLKRKPPSTNAGRGQKHRLTCPSCDSYEKKPPKEFLERFKSLLQKMIHQHLSSRTHGSEDS | 1.349 | 1885 |
| IL-21_4985 | T110D, A112P, R114Q, H118D | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGQRQKDRLTCPSCDSYEKKPPKEFLERFKSLLQKMIHQHLSSRTHGSEDS | 1.352 | 1886 |
| IL-21_5385 | N70G, P107V, R115D, T121E | MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGRDQKHRLECPSCDSYEKKPPKEFLERFKSLLQKMIHQHLSSRTHGSEDS | 1.352 | 1887 |
| IL-21_4945 | T110D, R115G, R119T, T121E | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRGQKHTLECPSCDSYEKKPPKEFLERFKSLLQKMIHQHLSSRTHGSEDS | 1.357 | 1888 |
| IL-21_6026 | H35F, N70G, A112P, R114G | MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSTNPGGRQKHRLTCPSCDSYEKKPPKEFLERFKSLLQKMIHQHLSSRTHGSEDS | 1.357 | 1889 |
| IL-21_5325 | N70G, R114Q, R119T, T121E | MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGQRQKHTLECPSCDSYEKKPPKEFLERFKSLLQKMIHQHLSSRTHGSEDS | 1.358 | 1890 |
| IL-21_5393 | N70G, P107V, R114Q, T121E | MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGQRQKHRLECPSCDSYEKKPPKEFLERFKSLLQKMIHQHLSSRTHGSEDS | 1.358 | 1891 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5950 | H35F, A112P, R114G, R115G | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKPPSTNPGGGQKHRLTCP SCDSYEKKPPKEFLERFKSLLQKMIHQHLSSRTHGSEDS | 1.358 | 1892 |
| IL-21_5844 | N70G, V98E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINESIKKLKRKPPSTNAGRRQKHRLTCP SCDSYEKKPPKEFLERFKSLLQKMIHQHLSSRTHGSEDS | 1.358 | 1893 |
| IL-21_5566 | T110D, R114G, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGGDQKHRLTCP SCDSYEKKPPKEFLERFKSLLQKMIHQHLSSRTHGSEDS | 1.359 | 1894 |
| IL-21_5383 | N70G, P107V, R115G, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGRGQKHTLTCP SCDSYEKKPPKEFLERFKSLLQKMIHQHLSSRTHGSEDS | 1.359 | 1895 |
| IL-21_5824 | K81D, T121E | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNAGRRQKHRLECP SCDSYEKKPPKEFLERFKSLLQKMIHQHLSSRTHGSEDS | 1.361 | 1896 |
| IL-21_5568 | T110D, R114Q, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGQRQKHTLTCP SCDSYEKKPPKEFLERFKSLLQKMIHQHLSSRTHGSEDS | 1.362 | 1897 |
| IL-21_5023 | P107V, A112P, R114G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGGRQKHTLTCP SCDSYEKKPPKEFLERFKSLLQKMIHQHLSSRTHGSEDS | 1.364 | 1898 |
| IL-21_5560 | T110D, R115D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRDQKHTLTCP SCDSYEKKPPKEFLERFKSLLQKMIHQHLSSRTHGSEDS | 1.365 | 1899 |
| IL-21_5378 | N70G, T110D, A112P, R114Q | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNPGQRQKHRLTCP SCDSYEKKPPKEFLERFKSLLQKMIHQHLSSRTHGSEDS | 1.366 | 1900 |
| IL-21_5851 | I45T, T110D, R114G, R115D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSDNAGGDQKHRLTCP SCDSYEKKPPKEFLERFKSLLQKMIHQHLSSRTHGSEDS | 1.368 | 1901 |
| IL-21_6210 | H35I, I45T, T110D, R114G | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKPPSDNAGGRQKHRLTCP SCDSYEKKPPKEFLERFKSLLQKMIHQHLSSRTHGSEDS | 1.369 | 1902 |
| IL-21_5849 | I45T, A112P, R114Q, R115D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSTNPGQDQKHRLTCP SCDSYEKKPPKEFLERFKSLLQKMIHQHLSSRTHGSEDS | 1.372 | 1903 |
| IL-21_6420 | H35I, K81D | MRSSPGNMERIVICLMVIFLGTLVHKSSSQGQDRIMIRMRQ LIDIVDQLKNYVNDLVPEFLPAPEDVETNCEWSAFSCFQDA QLKSANTGNNERIINVSIKKLKRKPPSTNAGRRQKHRLTCP SCDSYEKKPPKEFLERFKSLLQKMIHQHLSSRTHGSEDS | 1.373 | 1904 |
| IL-21_5609 | P107V, T110D, R114G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGGRQKHRLTCP SCDSYEKKPPKEFLERFKSLLQKMIHQHLSSRTHGSEDS | 1.374 | 1905 |
| IL-21_5356 | N70G, T110D, R115G, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGRGQKHRLECP SCDSYEKKPPKEFLERFKSLLQKMIHQHLSSRTHGSEDS | 1.376 | 1906 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_6214 | H35I, I45T, P107V, R115D | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKVPSTNAGRDQKHRLTCP SCDSYEKKPPKEFLERFKSLLQKMIHQHLSSRTHGSEDS | 1.378 | 1907 |
| IL-21_5329 | N70G, R114Q, R115G, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGQGQKHTLTCP SCDSYEKKPPKEFLERFKSLLQKMIHQHLSSRTHGSEDS | 1.378 | 1908 |
| IL-21_5569 | T110D, R114Q, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGQRQKDRLTCP SCDSYEKKPPKEFLERFKSLLQKMIHQHLSSRTHGSEDS | 1.379 | 1909 |
| IL-21_5860 | I45T, P107V, R114Q, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKVPSTNAGQGQKHRLTCP SCDSYEKKPPKEFLERFKSLLQKMIHQHLSSRTHGSEDS | 1.38 | 1910 |
| IL-21_5855 | I45T, T110D, A112P, R115D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSDNPGRDQKHRLTCP SCDSYEKKPPKEFLERFKSLLQKMIHQHLSSRTHGSEDS | 1.38 | 1911 |
| IL-21_5596 | P107V, R114Q, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGQGQKHRLTCP SCDSYEKKPPKEFLERFKSLLQKMIHQHLSSRTHGSEDS | 1.381 | 1912 |
| IL-21_6177 | H35I, N70G, T110D, R114G | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKPPSDNAGGRQKHRLTCP SCDSYEKKPPKEFLERFKSLLQKMIHQHLSSRTHGSEDS | 1.381 | 1913 |
| IL-21_5342 | N70G, A112P, R115D, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGRDQKDRLTCP SCDSYEKKPPKEFLERFKSLLQKMIHQHLSSRTHGSEDS | 1.382 | 1914 |
| IL-21_6241 | H351, I45T, N70G, V98E | MRSSPGNMERIVICLMVIFLGTLVHKSSSQGQDRIMIRMRQ LIDTVDQLKNYVNDLVPEFLPAPEDVETGCEWSAFSCFQKA QLKSANTGNNERIINESIKKLKRKPPSTNAGRRQKHRLTCP SCDSYEKKPPKEFLERFKSLLQKMIHQHLSSRTHGSEDS | 1.382 | 1915 |
| IL-21_4928 | A112P, R114G, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGGRQKDTLTCP SCDSYEKKPPKEFLERFKSLLQKMIHQHLSSRTHGSEDS | 1.383 | 1916 |
| IL-21_5581 | P107V, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGRRQKDTLTCP SCDSYEKKPPKEFLERFKSLLQKMIHQHLSSRTHGSEDS | 1.384 | 1917 |
| IL-21_6235 | H35I, I45T, N70G, R115D | MRSSPGNMERIVICLMVIFLGTLVHKSSSQGQDRIMIRMRQ LIDTVDQLKNYVNDLVPEFLPAPEDVETGCEWSAFSCFQKA QLKSANTGNNERIINVSIKKLKRKPPSTNAGRDQKHRLTCP SCDSYEKKPPKEFLERFKSLLQKMIHQHLSSRTHGSEDS | 1.386 | 1918 |
| IL-21_6062 | H35F, I45T, T110D, R115G | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINVSIKKLKRKPPSDNAGRGQKHRLTCP SCDSYEKKPPKEFLERFKSLLQKMIHQHLSSRTHGSEDS | 1.386 | 1919 |
| IL-21_6099 | H35I, A112P, R114Q, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSTNPGQGQKHRLTCP SCDSYEKKPPKEFLERFKSLLQKMIHQHLSSRTHGSEDS | 1.388 | 1920 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_6119 | H35I, P107V, T110D, R114G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKVPSDNAGGRQKHRLTCP SCDSYEKKPPKEFLERFKSLLQKMIHQHLSSRTHGSEDS | 1.389 | 1921 |
| IL-21_6205 | H35I, I45T, A112P, R115D | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKPPSTNPGRDQKHRLTCP SCDSYEKKPPKEFLERFKSLLQKMIHQHLSSRTHGSEDS | 1.39 | 1922 |
| IL-21_5584 | P107V, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGRGQKDRLTCP SCDSYEKKPPKEFLERFKSLLQKMIHQHLSSRTHGSEDS | 1.391 | 1923 |
| IL-21_5388 | N70G, P107V, R114G, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGGRQKHRLECP SCDSYEKKPPKEFLERFKSLLQKMIHQHLSSRTHGSEDS | 1.393 | 1924 |
| IL-21_4941 | A112P, R114Q, R115D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGQDQKHRLECP SCDSYEKKPPKEFLERFKSLLQKMIHQHLSSRTHGSEDS | 1.394 | 1925 |
| IL-21_5029 | P107V, A112P, R114Q, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGQRQKDRLTCP SCDSYEKKPPKEFLERFKSLLQKMIHQHLSSRTHGSEDS | 1.395 | 1926 |
| IL-21_4906 | R114G, R115G, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGGGQKHTLECP SCDSYEKKPPKEFLERFKSLLQKMIHQHLSSRTHGSEDS | 1.395 | 1927 |
| IL-21_5035 | P107V, T110D, R115G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGRGQKHRLECP SCDSYEKKPPKEFLERFKSLLQKMIHQHLSSRTHGSEDS | 1.397 | 1928 |
| IL-21_6299 | H35F, P107V, R115D | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKVPSTNAGRDQKHRLTCP SCDSYEKKPPKEFLERFKSLLQKMIHQHLSSRTHGSEDS | 1.398 | 1929 |
| IL-21_5395 | N70G, P107V, R114Q, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGQRQKDRLTCP SCDSYEKKPPKEFLERFKSLLQKMIHQHLSSRTHGSEDS | 1.4 | 1930 |
| IL-21_5875 | I45T, V98E, A112P, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKPPSTNPGRGQKHRLTCP SCDSYEKKPPKEFLERFKSLLQKMIHQHLSSRTHGSEDS | 1.401 | 1931 |
| IL-21_6065 | H35F, I45T, T110D, R114Q | MRSSPGNMERIVICLMVIFLGTLVHKSSSQGQDRFMIRMRQ LIDTVDQLKNYVNDLVPEFLPAPEDVETNCEWSAFSCFQKA QLKSANTGNNERIINVSIKKLKRKPPSDNAGQRQKHRLTCP SCDSYEKKPPKEFLERFKSLLQKMIHQHLSSRTHGSEDS | 1.401 | 1932 |
| IL-21_4927 | A112P, R114G, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGGRQKDRLECP SCDSYEKKPPKEFLERFKSLLQKMIHQHLSSRTHGSEDS | 1.402 | 1933 |
| IL-21_5938 | I45T, N70G, V98E, R114Q | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINESIKKLKRKPPSTNAGQRQKHRLTCP SCDSYEKKPPKEFLERFKSLLQKMIHQHLSSRTHGSEDS | 1.403 | 1934 |
| IL-21_6179 | H35I, N70G, P107V, R115G | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKVPSTNAGRGQKHRLTCP SCDSYEKKPPKEFLERFKSLLQKMIHQHLSSRTHGSEDS | 1.403 | 1935 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5918 | I45T, N70G, R114Q, R115G | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKPPSTNAGQGQKHRLTCP SCDSYEKKPPKEFLERFKSLLQKMIHQHLSSRTHGSEDS | 1.403 | 1936 |
| IL-21_5590 | P107V, R114G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGGRQKDRLTCP SCDSYEKKPPKEFLERFKSLLQKMIHQHLSSRTHGSEDS | 1.403 | 1937 |
| IL-21_4963 | T110D, R114Q, R115G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGQGQKHRLECP SCDSYEKKPPKEFLERFKSLLQKMIHQHLSSRTHGSEDS | 1.403 | 1938 |
| IL-21_5526 | R114Q, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGQRQKDRLECP SCDSYEKKPPKEFLERFKSLLQKMIHQHLSSRTHGSEDS | 1.406 | 1939 |
| IL-21_5570 | T110D, R114Q, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGQGQKHRLTCP SCDSYEKKPPKEFLERFKSLLQKMIHQHLSSRTHGSEDS | 1.407 | 1940 |
| IL-21_4974 | T110D, A112P, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGRGQKDRLTCP SCDSYEKKPPKEFLERFKSLLQKMIHQHLSSRTHGSEDS | 1.408 | 1941 |
| IL-21_5863 | I45T, P107V, A112P, R115D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKVPSTNPGRDQKHRLTCP SCDSYEKKPPKEFLERFKSLLQKMIHQHLSSRTHGSEDS | 1.409 | 1942 |
| IL-21_6028 | H35F, N70G, T110D, R115G | MRSSPGNMERIVICLMVIFLGTLVHKSSSQGQDRFMIRMRQ LIDIVDQLKNYVNDLVPEFLPAPEDVETGCEWSAFSCFQKA QLKSANTGNNERIINVSIKKLKRKPPSDNAGRGQKHRLTCP SCDSYEKKPPKEFLERFKSLLQKMIHQHLSSRTHGSEDS | 1.41 | 1943 |
| IL-21_4932 | A112P, R114G, R115D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGGDQKHRLECP SCDSYEKKPPKEFLERFKSLLQKMIHQHLSSRTHGSEDS | 1.41 | 1944 |
| IL-21_5868 | I45T, P107V, T110D, R114G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKVPSDNAGGRQKHRLTCP SCDSYEKKPPKEFLERFKSLLQKMIHQHLSSRTHGSEDS | 1.411 | 1945 |
| IL-21_5580 | P107V, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGRRQKDRLECP SCDSYEKKPPKEFLERFKSLLQKMIHQHLSSRTHGSEDS | 1.411 | 1946 |
| IL-21_6139 | H35I, V98E, P107V, A112P | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINESIKKLKRKVPSTNPGRRQKHRLTCP SCDSYEKKPPKEFLERFKSLLQKMIHQHLSSRTHGSEDS | 1.412 | 1947 |
| IL-21_6290 | H35F, A112P, R115D | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKPPSTNPGRDQKHRLTCP SCDSYEKKPPKEFLERFKSLLQKMIHQHLSSRTHGSEDS | 1.416 | 1948 |
| IL-21_5053 | P107V, T110D, A112P, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNPGRRQKDRLTCP SCDSYEKKPPKEFLERFKSLLQKMIHQHLSSRTHGSEDS | 1.417 | 1949 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_6173 | H35I, N70G, A112P, R114G | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKPPSTNPGGRQKHRLTCP SCDSYEKKPPKEFLERFKSLLQKMIHQHLSSRTHGSEDS | 1.417 | 1950 |
| IL-21_5601 | P107V, A112P, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGRDQKHRLTCP SCDSYEKKPPKEFLERFKSLLQKMIHQHLSSRTHGSEDS | 1.417 | 1951 |
| IL-21_5041 | P107V, T110D, R114G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGGRQKHRLECP SCDSYEKKPPKEFLERFKSLLQKMIHQHLSSRTHGSEDS | 1.42 | 1952 |
| IL-21_5340 | N70G, A112P, R115D, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGRDQKHRLECP SCDSYEKKPPKEFLERFKSLLQKMIHQHLSSRTHGSEDS | 1.421 | 1953 |
| IL-21_5852 | I45T, T110D, R114Q, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSDNAGQGQKHRLTCP SCDSYEKKPPKEFLERFKSLLQKMIHQHLSSRTHGSEDS | 1.422 | 1954 |
| IL-21_6389 | H35I, I45T, K81D | MRSSPGNMERIVICLMVIFLGTLVHKSSSQGQDRIMIRMRQ LIDTVDQLKNYVNDLVPEFLPAPEDVETNCEWSAFSCFQDA QLKSANTGNNERIINVSIKKLKRKPPSTNAGRRQKHRLTCP SCDSYEKKPPKEFLERFKSLLQKMIHQHLSSRTHGSEDS | 1.422 | 1955 |
| IL-21_6033 | H35F, N70G, P107V, R115G | MRSSPGNMERIVICLMVIFLGTLVHKSSSQGQDREMIRMRQ LIDIVDQLKNYVNDLVPEFLPAPEDVETGCEWSAFSCFQKA QLKSANTGNNERIINVSIKKLKRKVPSTNAGRGQKHRLTCP SCDSYEKKPPKEFLERFKSLLQKMIHQHLSSRTHGSEDS | 1.422 | 1956 |
| IL-21_6264 | I45T, V98E, R114G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKPPSTNAGGRQKHRLTCP SCDSYEKKPPKEFLERFKSLLQKMIHQHLSSRTHGSEDS | 1.422 | 1957 |
| IL-21_5823 | V98E, P107V | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNAGRRQKHRLTCP SCDSYEKKPPKEFLERFKSLLQKMIHQHLSSRTHGSEDS | 1.424 | 1958 |
| IL-21_4922 | A112P, R115G, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRGQKDTLTCP SCDSYEKKPPKEFLERFKSLLQKMIHQHLSSRTHGSEDS | 1.424 | 1959 |
| IL-21_5883 | I45T, V98E, T110D, A112P | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKPPSDNPGRRQKHRLTCP SCDSYEKKPPKEFLERFKSLLQKMIHQHLSSRTHGSEDS | 1.426 | 1960 |
| IL-21_5547 | A112P, R114G, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGGDQKHRLTCP SCDSYEKKPPKEFLERFKSLLQKMIHQHLSSRTHGSEDS | 1.426 | 1961 |
| IL-21_4930 | A112P, R114G, R115G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGGGQKHTLTCP SCDSYEKKPPKEFLERFKSLLQKMIHQHLSSRTHGSEDS | 1.427 | 1962 |
| IL-21_6375 | H35I, N70G, R114Q | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKPPSTNAGQRQKHRLTCP SCDSYEKKPPKEFLERFKSLLQKMIHQHLSSRTHGSEDS | 1.427 | 1963 |
| IL-21_4970 | T110D, A112P, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGRRQKDRLECP SCDSYEKKPPKEFLERFKSLLQKMIHQHLSSRTHGSEDS | 1.427 | 1964 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5531 | R114Q, R115D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGQDQKHRLECP SCDSYEKKPPKEFLERFKSLLQKMIHQHLSSRTHGSEDS | 1.428 | 1965 |
| IL-21_6184 | H35I, N70G, 1P07V, T110D | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKVPSDNAGRRQKHRLTCP SCDSYEKKPPKEFLERFKSLLQKMIHQHLSSRTHGSEDS | 1.428 | 1966 |
| IL-21_6181 | H35I, N70G, P107V, R114G | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKVPSTNAGGRQKHRLTCP SCDSYEKKPPKEFLERFKSLLQKMIHQHLSSRTHGSEDS | 1.428 | 1967 |
| IL-21_6273 | I45T, K81D, A112P | MRSSPGNMERIVICLMVIFLGTLVHKSSSQGQDRHMIRMRQ LIDTVDQLKNYVNDLVPEFLPAPEDVETNCEWSAFSCFQDA QLKSANTGNNERIINVSIKKLKRKPPSTNPGRRQKHRLTCP SCDSYEKKPPKEFLERFKSLLQKMIHQHLSSRTHGSEDS | 1.43 | 1968 |
| IL-21_5542 | A112P, R115D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRDQKDRLTCP SCDSYEKKPPKEFLERFKSLLQKMIHQHLSSRTHGSEDS | 1.43 | 1969 |
| IL-21_5032 | P107V, T110D, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGRRQKHTLECP SCDSYEKKPPKEFLERFKSLLQKMIHQHLSSRTHGSEDS | 1.43 | 1970 |
| IL-21_5958 | H35F, T110D, A112P, R115G | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKPPSDNPGRGQKHRLTCP SCDSYEKKPPKEFLERFKSLLQKMIHQHLSSRTHGSEDS | 1.431 | 1971 |
| IL-21_6388 | H35I, I45T, V98E | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINESIKKLKRKPPSTNAGRRQKHRLTCP SCDSYEKKPPKEFLERFKSLLQKMIHQHLSSRTHGSEDS | 1.432 | 1972 |
| IL-21_5527 | R114Q, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGQRQKDTLTCP SCDSYEKKPPKEFLERFKSLLQKMIHQHLSSRTHGSEDS | 1.433 | 1973 |
| IL-21_6352 | H35I, P107V, R115D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKVPSTNAGRDQKHRLTCP SCDSYEKKPPKEFLERFKSLLQKMIHQHLSSRTHGSEDS | 1.433 | 1974 |
| IL-21_6286 | H35F, R114G, R115D | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKPPSTNAGGDQKHRLTCP SCDSYEKKPPKEFLERFKSLLQKMIHQHLSSRTHGSEDS | 1.434 | 1975 |
| IL-21_6319 | H35F, N70G, R115G | MRSSPGNMERIVICLMVIFLGTLVHKSSSQGQDRFMIRMRQ LIDIVDQLKNYVNDLVPEFLPAPEDVETGCEWSAFSCFQKA QLKSANTGNNERIINVSIKKLKRKPPSTNAGRGQKHRLTCP SCDSYEKKPPKEFLERFKSLLQKMIHQHLSSRTHGSEDS | 1.435 | 1976 |
| IL-21_4921 | A112P, R115G, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRGQKDRLECP SCDSYEKKPPKEFLERFKSLLQKMIHQHLSSRTHGSEDS | 1.436 | 1977 |
| IL-21_5877 | I45T, V98E, A112P, R114G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKPPSTNPGGRQKHRLTCP SCDSYEKKPPKEFLERFKSLLQKMIHQHLSSRTHGSEDS | 1.436 | 1978 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5565 | T110D, R114G, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGGGQKHRLTCP SCDSYEKKPPKEFLERFKSLLQKMIHQHLSSRTHGSEDS | 1.438 | 1979 |
| IL-21_6182 | H35I, N70G, P107V, R114Q | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKVPSTNAGQRQKHRLTCP SCDSYEKKPPKEFLERFKSLLQKMIHQHLSSRTHGSEDS | 1.441 | 1980 |
| IL-21_6329 | H35F, I45T, R115D | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINVSIKKLKRKPPSTNAGRDQKHRLTCP SCDSYEKKPPKEFLERFKSLLQKMIHQHLSSRTHGSEDS | 1.441 | 1981 |
| IL-21_6402 | H35F, R115D | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKPPSTNAGRDQKHRLTCP SCDSYEKKPPKEFLERFKSLLQKMIHQHLSSRTHGSEDS | 1.442 | 1982 |
| IL-21_6171 | H35I, N70G, A112P, R115G | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKPPSTNPGRGQKHRLTCP SCDSYEKKPPKEFLERFKSLLQKMIHQHLSSRTHGSEDS | 1.443 | 1983 |
| IL-21_5346 | N70G, A112P, R114G, R115G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGGGQKHRLTCP SCDSYEKKPPKEFLERFKSLLQKMIHQHLSSRTHGSEDS | 1.444 | 1984 |
| IL-21_6252 | I45T, T110D, R115D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSDNAGRDQKHRLTCP SCDSYEKKPPKEFLERFKSLLQKMIHQHLSSRTHGSEDS | 1.446 | 1985 |
| IL-21_6090 | H35F, I45T, N70G, R114G | MRSSPGNMERIVICLMVIFLGTLVHKSSSQGQDRFMIRMRQ LIDTVDQLKNYVNDLVPEFLPAPEDVETGCEWSAFSCFQKA QLKSANTGNNERIINVSIKKLKRKPPSTNAGGRQKHRLTCP SCDSYEKKPPKEFLERFKSLLQKMIHQHLSSRTHGSEDS | 1.448 | 1986 |
| IL-21_4973 | T110D, A112P, R115G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGRGQKHTLTCP SCDSYEKKPPKEFLERFKSLLQKMIHQHLSSRTHGSEDS | 1.448 | 1987 |
| IL-21_5713 | N70G, R115G, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRGQKDRLTCP SCDSYEKKPPKEFLERFKSLLQKMIHQHLSSRTHGSEDS | 1.449 | 1988 |
| IL-21_5341 | N70G, A112P, R115D, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGRDQKHTLTCP SCDSYEKKPPKEFLERFKSLLQKMIHQHLSSRTHGSEDS | 1.449 | 1989 |
| IL-21_5710 | N70G, H118D, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRRQKDTLTCP SCDSYEKKPPKEFLERFKSLLQKMIHQHLSSRTHGSEDS | 1.451 | 1990 |
| IL-21_5576 | T110D, A112P, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGRDQKHRLTCP SCDSYEKKPPKEFLERFKSLLQKMIHQHLSSRTHGSEDS | 1.452 | 1991 |
| IL-21_5858 | I45T, P107V, R114G, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKVPSTNAGGGQKHRLTCP SCDSYEKKPPKEFLERFKSLLQKMIHQHLSSRTHGSEDS | 1.452 | 1992 |
| IL-21_6027 | H35F, N70G, A112P, R114Q | MRSSPGNMERIVICLMVIFLGTLVHKSSSQGQDREMIRMRQ LIDIVDQLKNYVNDLVPEFLPAPEDVETGCEWSAFSCFQKA QLKSANTGNNERIINVSIKKLKRKPPSTNPGQRQKHRLTCP SCDSYEKKPPKEFLERFKSLLQKMIHQHLSSRTHGSEDS | 1.456 | 1993 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5555 | T110D, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRRQKDTLTCP SCDSYEKKPPKEFLERFKSLLQKMIHQHLSSRTHGSEDS | 1.458 | 1994 |
| IL-21_5552 | A112P, R114Q, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGQDQKHRLTCP SCDSYEKKPPKEFLERFKSLLQKMIHQHLSSRTHGSEDS | 1.461 | 1995 |
| IL-21_6338 | H35I, R114G, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSTNAGGGQKHRLTCP SCDSYEKKPPKEFLERFKSLLQKMIHQHLSSRTHGSEDS | 1.461 | 1996 |
| IL-21_5779 | R115D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGRDQKDRLTCP SCDSYEKKPPKEFLERFKSLLQKMIHQHLSSRTHGSEDS | 1.461 | 1997 |
| IL-21_5353 | N70G, T110D, R119T, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGRRQKHTLECP SCDSYEKKPPKEFLERFKSLLQKMIHQHLSSRTHGSEDS | 1.462 | 1998 |
| IL-21_5736 | N70G, T110D, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGRRQKDRLTCP SCDSYEKKPPKEFLERFKSLLQKMIHQHLSSRTHGSEDS | 1.463 | 1999 |
| IL-21_5558 | T110D, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRGQKDRLTCP SCDSYEKKPPKEFLERFKSLLQKMIHQHLSSRTHGSEDS | 1.464 | 2000 |
| IL-21_5709 | N70G, H118D, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRRQKDRLECP SCDSYEKKPPKEFLERFKSLLQKMIHQHLSSRTHGSEDS | 1.465 | 2001 |
| IL-21_6174 | H35I, N70G, A112P, R114Q | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKPPSTNPGQRQKHRLTCP SCDSYEKKPPKEFLERFKSLLQKMIHQHLSSRTHGSEDS | 1.468 | 2002 |
| IL-21_4986 | T110D, A112P, R114Q, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGQGQKHRLTCP SCDSYEKKPPKEFLERFKSLLQKMIHQHLSSRTHGSEDS | 1.469 | 2003 |
| IL-21_5960 | H35F, T110D, A112P, R114G | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKPPSDNPGGRQKHRLTCP SCDSYEKKPPKEFLERFKSLLQKMIHQHLSSRTHGSEDS | 1.471 | 2004 |
| IL-21_6105 | H35I, T110D, A112P, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSDNPGRGQKHRLTCP SCDSYEKKPPKEFLERFKSLLQKMIHQHLSSRTHGSEDS | 1.471 | 2005 |
| IL-21_6223 | H35I, I45T, V98E, A112P | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINESIKKLKRKPPSTNPGRRQKHRLTCP SCDSYEKKPPKEFLERFKSLLQKMIHQHLSSRTHGSEDS | 1.472 | 2006 |
| IL-21_5606 | P107V, T110D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGRRQKDRLTCP SCDSYEKKPPKEFLERFKSLLQKMIHQHLSSRTHGSEDS | 1.473 | 2007 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5789 | R114Q, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGQDQKHRLTCP SCDSYEKKPPKEFLERFKSLLQKMIHQHLSSRTHGSEDS | 1.476 | 2008 |
| IL-21_6064 | H35F, I45T, T110D, R114G | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINVSIKKLKRKPPSDNAGGRQKHRLTCP SCDSYEKKPPKEFLERFKSLLQKMIHQHLSSRTHGSEDS | 1.477 | 2009 |
| IL-21_5054 | P107V, T110D, A112P, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNPGRGQKHRLTCP SCDSYEKKPPKEFLERFKSLLQKMIHQHLSSRTHGSEDS | 1.477 | 2010 |
| IL-21_5522 | R114G, R115D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGGDQKHRLECP SCDSYEKKPPKEFLERFKSLLQKMIHQHLSSRTHGSEDS | 1.477 | 2011 |
| IL-21_6116 | H35I, P107V, A112P, R114Q | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKVPSTNPGQRQKHRLTCP SCDSYEKKPPKEFLERFKSLLQKMIHQHLSSRTHGSEDS | 1.478 | 2012 |
| IL-21_5541 | A112P, R115D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRDQKHTLTCP SCDSYEKKPPKEFLERFKSLLQKMIHQHLSSRTHGSEDS | 1.478 | 2013 |
| IL-21_5350 | N70G, A112P, R114Q, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGQRQKDRLTCP SCDSYEKKPPKEFLERFKSLLQKMIHQHLSSRTHGSEDS | 1.479 | 2014 |
| IL-21_6265 | I45T, V98E, R114Q | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKPPSTNAGQRQKHRLTCP SCDSYEKKPPKEFLERFKSLLQKMIHQHLSSRTHGSEDS | 1.481 | 2015 |
| IL-21_5724 | N70G, R114Q, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGQRQKDRLTCP SCDSYEKKPPKEFLERFKSLLQKMIHQHLSSRTHGSEDS | 1.483 | 2016 |
| IL-21_5046 | P107V, T110D, R114Q, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGQRQKHRLECP SCDSYEKKPPKEFLERFKSLLQKMIHQHLSSRTHGSEDS | 1.483 | 2017 |
| IL-21_4919 | A112P, H118D, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRRQKDTLECP SCDSYEKKPPKEFLERFKSLLQKMIHQHLSSRTHGSEDS | 1.484 | 2018 |
| IL-21_5966 | H35F, P107V, A112P, R115G | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKVPSTNPGRGQKHRLTCP SCDSYEKKPPKEFLERFKSLLQKMIHQHLSSRTHGSEDS | 1.485 | 2019 |
| IL-21_5401 | N70G, P107V, A112P, R115G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNPGRGQKHRLTCP SCDSYEKKPPKEFLERFKSLLQKMIHQHLSSRTHGSEDS | 1.485 | 2020 |
| IL-21_5784 | R114G, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGGDQKHRLTCP SCDSYEKKPPKEFLERFKSLLQKMIHQHLSSRTHGSEDS | 1.486 | 2021 |
| IL-21_6208 | H351, I45T, T110D, R115G | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKPPSDNAGRGQKHRLTCP SCDSYEKKPPKEFLERFKSLLQKMIHQHLSSRTHGSEDS | 1.49 | 2022 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5739 | N70G, T110D, R114G | MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGGRQKHRLTCPSCDSYEKKPPKEFLERFKSLLQKMIHQHLSSRTHGSEDS | 1.492 | 2023 |
| IL-21_5930 | I45T, N70G, P107V, R115D | MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKVPSTNAGRDQKHRLTCPSCDSYEKKPPKEFLERFKSLLQKMIHQHLSSRTHGSEDS | 1.492 | 2024 |
| IL-21_4971 | T110D, A112P, H118D, R119T | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGRRQKDTLTCPSCDSYEKKPPKEFLERFKSLLQKMIHQHLSSRTHGSEDS | 1.494 | 2025 |
| IL-21_5607 | P107V, T110D, R115G | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGRGQKHRLTCPSCDSYEKKPPKEFLERFKSLLQKMIHQHLSSRTHGSEDS | 1.496 | 2026 |
| IL-21_5056 | P107V, T110D, A112P, R114G | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNPGGRQKHRLTCPSCDSYEKKPPKEFLERFKSLLQKMIHQHLSSRTHGSEDS | 1.497 | 2027 |
| IL-21_4980 | T110D, A112P, R114G, H118D | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGGRQKDRLTCPSCDSYEKKPPKEFLERFKSLLQKMIHQHLSSRTHGSEDS | 1.498 | 2028 |
| IL-21_5916 | I45T, N70G, R114G, R115G | MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSTNAGGGQKHRLTCPSCDSYEKKPPKEFLERFKSLLQKMIHQHLSSRTHGSEDS | 1.499 | 2029 |
| IL-21_5511 | R115G, H118D, T121E | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRGQKDRLECPSCDSYEKKPPKEFLERFKSLLQKMIHQHLSSRTHGSEDS | 1.504 | 2030 |
| IL-21_5924 | I45T, N70G, T110D, R115G | MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSDNAGRGQKHRLTCPSCDSYEKKPPKEFLERFKSLLQKMIHQHLSSRTHGSEDS | 1.504 | 2031 |
| IL-21_6257 | I45T, P107V, R115D | MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSTNAGRDQKHRLTCPSCDSYEKKPPKEFLERFKSLLQKMIHQHLSSRTHGSEDS | 1.504 | 2032 |
| IL-21_6343 | H35I, A112P, R115D | MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSTNPGRDQKHRLTCPSCDSYEKKPPKEFLERFKSLLQKMIHQHLSSRTHGSEDS | 1.506 | 2033 |
| IL-21_4937 | A112P, R114Q, H118D, R119T | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGQRQKDTLTCPSCDSYEKKPPKEFLERFKSLLQKMIHQHLSSRTHGSEDS | 1.506 | 2034 |
| IL-21_5760 | N70G, V98E, P107V | MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKVPSTNAGRRQKHRLTCPSCDSYEKKPPKEFLERFKSLLQKMIHQHLSSRTHGSEDS | 1.508 | 2035 |
| IL-21_5748 | N70G, P107V, R114Q | MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGQRQKHRLTCPSCDSYEKKPPKEFLERFKSLLQKMIHQHLSSRTHGSEDS | 1.509 | 2036 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5588 | P107V, R114G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGGRQKHRLECP SCDSYEKKPPKEFLERFKSLLQKMIHQHLSSRTHGSEDS | 1.509 | 2037 |
| IL-21_5024 | P107V, A112P, R114G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGGRQKDRLTCP SCDSYEKKPPKEFLERFKSLLQKMIHQHLSSRTHGSEDS | 1.51 | 2038 |
| IL-21_5740 | N70G, T110D, R114Q | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGQRQKHRLTCP SCDSYEKKPPKEFLERFKSLLQKMIHQHLSSRTHGSEDS | 1.512 | 2039 |
| IL-21_6038 | H35F, N70G, P107V, T110D | MRSSPGNMERIVICLMVIFLGTLVHKSSSQGQDREMIRMRQ LIDIVDQLKNYVNDLVPEFLPAPEDVETGCEWSAFSCFQKA QLKSANTGNNERIINVSIKKLKRKVPSDNAGRRQKHRLTCP SCDSYEKKPPKEFLERFKSLLQKMIHQHLSSRTHGSEDS | 1.512 | 2040 |
| IL-21_6298 | H35F, P107V, R115G | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKVPSTNAGRGQKHRLTCP SCDSYEKKPPKEFLERFKSLLQKMIHQHLSSRTHGSEDS | 1.513 | 2041 |
| IL-21_5814 | V98E, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNAGRRQKHRLECP SCDSYEKKPPKEFLERFKSLLQKMIHQHLSSRTHGSEDS | 1.513 | 2042 |
| IL-21_6335 | H35F, I45T, V98E | MRSSPGNMERIVICLMVIFLGTLVHKSSSQGQDRFMIRMRQ LIDTVDQLKNYVNDLVPEFLPAPEDVETNCEWSAFSCFQKA QLKSANTGNNERIINESIKKLKRKPPSTNAGRRQKHRLTCP SCDSYEKKPPKEFLERFKSLLQKMIHQHLSSRTHGSEDS | 1.514 | 2043 |
| IL-21_6211 | H351, I45T, T110D, R114Q | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKPPSDNAGQRQKHRLTCP SCDSYEKKPPKEFLERFKSLLQKMIHQHLSSRTHGSEDS | 1.516 | 2044 |
| IL-21_5517 | R114G, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGGRQKDRLECP SCDSYEKKPPKEFLERFKSLLQKMIHQHLSSRTHGSEDS | 1.517 | 2045 |
| IL-21_5847 | I45T, A112P, R114G, R115D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSTNPGGDQKHRLTCP SCDSYEKKPPKEFLERFKSLLQKMIHQHLSSRTHGSEDS | 1.517 | 2046 |
| IL-21_5337 | N70G, A112P, R115G, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGRGQKHRLECP SCDSYEKKPPKEFLERFKSLLQKMIHQHLSSRTHGSEDS | 1.519 | 2047 |
| IL-21_6322 | H35F, N70G, R114Q | MRSSPGNMERIVICLMVIFLGTLVHKSSSQGQDRFMIRMRQ LIDIVDQLKNYVNDLVPEFLPAPEDVETGCEWSAFSCFQKA QLKSANTGNNERIINVSIKKLKRKPPSTNAGQRQKHRLTCP SCDSYEKKPPKEFLERFKSLLQKMIHQHLSSRTHGSEDS | 1.52 | 2048 |
| IL-21_4975 | T110D, A112P, R115D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGRDQKHRLECP SCDSYEKKPPKEFLERFKSLLQKMIHQHLSSRTHGSEDS | 1.52 | 2049 |
| IL-21_5927 | I45T, N70G, T110D, R114Q | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKPPSDNAGQRQKHRLTCP SCDSYEKKPPKEFLERFKSLLQKMIHQHLSSRTHGSEDS | 1.522 | 2050 |
| IL-21_5850 | I45T, T110D, R114G, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSDNAGGGQKHRLTCP SCDSYEKKPPKEFLERFKSLLQKMIHQHLSSRTHGSEDS | 1.523 | 2051 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5521 | R114G, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGGGQKDRLTCP SCDSYEKKPPKEFLERFKSLLQKMIHQHLSSRTHGSEDS | 1.524 | 2052 |
| IL-21_6036 | H35F, N70G, P107V, R114Q | MRSSPGNMERIVICLMVIFLGTLVHKSSSQGQDREMIRMRQ LIDIVDQLKNYVNDLVPEFLPAPEDVETGCEWSAFSCFQKA QLKSANTGNNERIINVSIKKLKRKVPSTNAGQRQKHRLTCP SCDSYEKKPPKEFLERFKSLLQKMIHQHLSSRTHGSEDS | 1.527 | 2053 |
| IL-21_4960 | T110D, R114Q, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGQRQKHTLECP SCDSYEKKPPKEFLERFKSLLQKMIHQHLSSRTHGSEDS | 1.528 | 2054 |
| IL-21_6321 | H35F, N70G, R114G | MRSSPGNMERIVICLMVIFLGTLVHKSSSQGQDRFMIRMRQ LIDIVDQLKNYVNDLVPEFLPAPEDVETGCEWSAFSCFQKA QLKSANTGNNERIINVSIKKLKRKPPSTNAGGRQKHRLTCP SCDSYEKKPPKEFLERFKSLLQKMIHQHLSSRTHGSEDS | 1.529 | 2055 |
| IL-21_5878 | I45T, V98E, A112P, R114Q | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKPPSTNPGQRQKHRLTCP SCDSYEKKPPKEFLERFKSLLQKMIHQHLSSRTHGSEDS | 1.53 | 2056 |
| IL-21_6382 | H35I, I45T, R115D | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKPPSTNAGRDQKHRLTCP SCDSYEKKPPKEFLERFKSLLQKMIHQHLSSRTHGSEDS | 1.53 | 2057 |
| IL-21_5336 | N70G, A112P, H118D, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGRRQKDTLTCP SCDSYEKKPPKEFLERFKSLLQKMIHQHLSSRTHGSEDS | 1.532 | 2058 |
| IL-21_6035 | H35F, N70G, P107V, R114G | MRSSPGNMERIVICLMVIFLGTLVHKSSSQGQDRFMIRMRQ LIDIVDQLKNYVNDLVPEFLPAPEDVETGCEWSAFSCFQKA QLKSANTGNNERIINVSIKKLKRKVPSTNAGGRQKHRLTCP SCDSYEKKPPKEFLERFKSLLQKMIHQHLSSRTHGSEDS | 1.533 | 2059 |
| IL-21_6216 | H35I, I45T, P107V, R114Q | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKVPSTNAGQRQKHRLTCP SCDSYEKKPPKEFLERFKSLLQKMIHQHLSSRTHGSEDS | 1.533 | 2060 |
| IL-21_4984 | T110D, A112P, R114Q, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGQRQKHTLTCP SCDSYEKKPPKEFLERFKSLLQKMIHQHLSSRTHGSEDS | 1.535 | 2061 |
| IL-21_5344 | N70G, A112P, R114G, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGGRQKHTLTCP SCDSYEKKPPKEFLERFKSLLQKMIHQHLSSRTHGSEDS | 1.537 | 2062 |
| IL-21_6225 | H35I, I45T, V98E, P107V | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINESIKKLKRKVPSTNAGRRQKHRLTCP SCDSYEKKPPKEFLERFKSLLQKMIHQHLSSRTHGSEDS | 1.538 | 2063 |
| IL-21_5921 | I45T, N70G, A112P, R115D | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKPPSTNPGRDQKHRLTCP SCDSYEKKPPKEFLERFKSLLQKMIHQHLSSRTHGSEDS | 1.54 | 2064 |
| IL-21_5821 | V98E, A112P | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKPPSTNPGRRQKHRLTCP SCDSYEKKPPKEFLERFKSLLQKMIHQHLSSRTHGSEDS | 1.543 | 2065 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5809 | P107V, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGRDQKHRLTCP SCDSYEKKPPKEFLERFKSLLQKMIHQHLSSRTHGSEDS | 1.545 | 2066 |
| IL-21_5941 | I45T, N70G, V98E, P107V | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINESIKKLKRKVPSTNAGRRQKHRLTCP SCDSYEKKPPKEFLERFKSLLQKMIHQHLSSRTHGSEDS | 1.546 | 2067 |
| IL-21_5382 | N70G, P107V, R115G, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGRGQKHRLECP SCDSYEKKPPKEFLERFKSLLQKMIHQHLSSRTHGSEDS | 1.546 | 2068 |
| IL-21_4979 | T110D, A112P, R114G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGGRQKHTLTCP SCDSYEKKPPKEFLERFKSLLQKMIHQHLSSRTHGSEDS | 1.548 | 2069 |
| IL-21_6403 | H35F, R114G | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKPPSTNAGGRQKHRLTCP SCDSYEKKPPKEFLERFKSLLQKMIHQHLSSRTHGSEDS | 1.548 | 2070 |
| IL-21_5509 | H118D, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGRRQKDTLECP SCDSYEKKPPKEFLERFKSLLQKMIHQHLSSRTHGSEDS | 1.55 | 2071 |
| IL-21_4981 | T110D, A112P, R114G, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGGGQKHRLTCP SCDSYEKKPPKEFLERFKSLLQKMIHQHLSSRTHGSEDS | 1.55 | 2072 |
| IL-21_6401 | H35F, R115G | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKPPSTNAGRGQKHRLTCP SCDSYEKKPPKEFLERFKSLLQKMIHQHLSSRTHGSEDS | 1.552 | 2073 |
| IL-21_5723 | N70G, R114Q, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGQRQKHTLTCP SCDSYEKKPPKEFLERFKSLLQKMIHQHLSSRTHGSEDS | 1.554 | 2074 |
| IL-21_5405 | N70G, P107V, T110D, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSDNAGRRQKHRLECP SCDSYEKKPPKEFLERFKSLLQKMIHQHLSSRTHGSEDS | 1.554 | 2075 |
| IL-21_4972 | T110D, A112P, R115G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGRGQKHRLECP SCDSYEKKPPKEFLERFKSLLQKMIHQHLSSRTHGSEDS | 1.555 | 2076 |
| IL-21_5394 | N70G, P107V, R114Q, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGQRQKHTLTCP SCDSYEKKPPKEFLERFKSLLQKMIHQHLSSRTHGSEDS | 1.557 | 2077 |
| IL-21_5589 | P107V, R114G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGGRQKHTLTCP SCDSYEKKPPKEFLERFKSLLQKMIHQHLSSRTHGSEDS | 1.56 | 2078 |
| IL-21_5831 | K81D, A112P | MRSSPGNMERIVICLMVIFLGTLVHKSSSQGQDRHMIRMRQ LIDIVDQLKNYVNDLVPEFLPAPEDVETNCEWSAFSCFQDA QLKSANTGNNERIINVSIKKLKRKPPSTNPGRRQKHRLTCP SCDSYEKKPPKEFLERFKSLLQKMIHQHLSSRTHGSEDS | 1.563 | 2079 |
| IL-21_5712 | N70G, R115G, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRGQKHTLTCP SCDSYEKKPPKEFLERFKSLLQKMIHQHLSSRTHGSEDS | 1.564 | 2080 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_6351 | H35I, P107V, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKVPSTNAGRGQKHRLTCP SCDSYEKKPPKEFLERFKSLLQKMIHQHLSSRTHGSEDS | 1.566 | 2081 |
| IL-21_5400 | N70G, P107V, A112P, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNPGRRQKDRLTCP SCDSYEKKPPKEFLERFKSLLQKMIHQHLSSRTHGSEDS | 1.568 | 2082 |
| IL-21_5406 | N70G, P107V, T110D, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSDNAGRRQKHTLTCP SCDSYEKKPPKEFLERFKSLLQKMIHQHLSSRTHGSEDS | 1.568 | 2083 |
| IL-21_6372 | H35I, N70G, R115G | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKPPSTNAGRGQKHRLTCP SCDSYEKKPPKEFLERFKSLLQKMIHQHLSSRTHGSEDS | 1.57 | 2084 |
| IL-21_5745 | N70G, P107V, R115G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGRGQKHRLTCP SCDSYEKKPPKEFLERFKSLLQKMIHQHLSSRTHGSEDS | 1.571 | 2085 |
| IL-21_5017 | P107V, A112P, R115G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGRGQKHTLTCP SCDSYEKKPPKEFLERFKSLLQKMIHQHLSSRTHGSEDS | 1.572 | 2086 |
| IL-21_5926 | I45T, N70G, T110D, R114G | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKPPSDNAGGRQKHRLTCP SCDSYEKKPPKEFLERFKSLLQKMIHQHLSSRTHGSEDS | 1.572 | 2087 |
| IL-21_6024 | H35F, N70G, A112P, R115G | MRSSPGNMERIVICLMVIFLGTLVHKSSSQGQDREMIRMRQ LIDIVDQLKNYVNDLVPEFLPAPEDVETGCEWSAFSCFQKA QLKSANTGNNERIINVSIKKLKRKPPSTNPGRGQKHRLTCP SCDSYEKKPPKEFLERFKSLLQKMIHQHLSSRTHGSEDS | 1.574 | 2088 |
| IL-21_6079 | H35F, I45T, V98E, P107V | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINESIKKLKRKVPSTNAGRRQKHRLTCP SCDSYEKKPPKEFLERFKSLLQKMIHQHLSSRTHGSEDS | 1.575 | 2089 |
| IL-21_5563 | T110D, R114G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGGRQKHTLTCP SCDSYEKKPPKEFLERFKSLLQKMIHQHLSSRTHGSEDS | 1.575 | 2090 |
| IL-21_6236 | H35I, I45T, N70G, R114G | MRSSPGNMERIVICLMVIFLGTLVHKSSSQGQDRIMIRMRQ LIDTVDQLKNYVNDLVPEFLPAPEDVETGCEWSAFSCFQKA QLKSANTGNNERIINVSIKKLKRKPPSTNAGGRQKHRLTCP SCDSYEKKPPKEFLERFKSLLQKMIHQHLSSRTHGSEDS | 1.576 | 2091 |
| IL-21_4936 | A112P, R114Q, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGQRQKDRLECP SCDSYEKKPPKEFLERFKSLLQKMIHQHLSSRTHGSEDS | 1.577 | 2092 |
| IL-21_6244 | I45T, R114G, R115D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSTNAGGDQKHRLTCP SCDSYEKKPPKEFLERFKSLLQKMIHQHLSSRTHGSEDS | 1.579 | 2093 |
| IL-21_5529 | R114Q, R115G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGQGQKHTLTCP SCDSYEKKPPKEFLERFKSLLQKMIHQHLSSRTHGSEDS | 1.579 | 2094 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5338 | N70G, A112P, R115G, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGRGQKHTLTCP SCDSYEKKPPKEFLERFKSLLQKMIHQHLSSRTHGSEDS | 1.584 | 2095 |
| IL-21_5539 | A112P, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRGQKDRLTCP SCDSYEKKPPKEFLERFKSLLQKMIHQHLSSRTHGSEDS | 1.585 | 2096 |
| IL-21_6115 | H35I, P107V, A112P, R114G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKVPSTNPGGRQKHRLTCP SCDSYEKKPPKEFLERFKSLLQKMIHQHLSSRTHGSEDS | 1.586 | 2097 |
| IL-21_5800 | T110D, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRGQKHRLTCP SCDSYEKKPPKEFLERFKSLLQKMIHQHLSSRTHGSEDS | 1.587 | 2098 |
| IL-21_5518 | R114G, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGGRQKDTLTCP SCDSYEKKPPKEFLERFKSLLQKMIHQHLSSRTHGSEDS | 1.588 | 2099 |
| IL-21_5373 | N70G, T110D, A112P, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNPGRRQKHTLTCP SCDSYEKKPPKEFLERFKSLLQKMIHQHLSSRTHGSEDS | 1.588 | 2100 |
| IL-21_4926 | A112P, R114G, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGGRQKHTLECP SCDSYEKKPPKEFLERFKSLLQKMIHQHLSSRTHGSEDS | 1.592 | 2101 |
| IL-21_6091 | H35F, I45T, N70G, R114Q | MRSSPGNMERIVICLMVIFLGTLVHKSSSQGQDREMIRMRQ LIDTVDQLKNYVNDLVPEFLPAPEDVETGCEWSAFSCFQKA QLKSANTGNNERIINVSIKKLKRKPPSTNAGQRQKHRLTCP SCDSYEKKPPKEFLERFKSLLQKMIHQHLSSRTHGSEDS | 1.593 | 2102 |
| IL-21_6077 | H35F, I45T, V98E, A112P | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINESIKKLKRKPPSTNPGRRQKHRLTCP SCDSYEKKPPKEFLERFKSLLQKMIHQHLSSRTHGSEDS | 1.593 | 2103 |
| IL-21_5718 | N70G, R114G, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGGRQKHTLTCP SCDSYEKKPPKEFLERFKSLLQKMIHQHLSSRTHGSEDS | 1.594 | 2104 |
| IL-21_4938 | A112P, R114Q, R115G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGQGQKHRLECP SCDSYEKKPPKEFLERFKSLLQKMIHQHLSSRTHGSEDS | 1.595 | 2105 |
| IL-21_5732 | N70G, A112P, R114G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGGRQKHRLTCP SCDSYEKKPPKEFLERFKSLLQKMIHQHLSSRTHGSEDS | 1.595 | 2106 |
| IL-21_5564 | T110D, R114G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGGRQKDRLTCP SCDSYEKKPPKEFLERFKSLLQKMIHQHLSSRTHGSEDS | 1.596 | 2107 |
| IL-21_5028 | P107V, A112P, R114Q, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGQRQKHTLTCP SCDSYEKKPPKEFLERFKSLLQKMIHQHLSSRTHGSEDS | 1.596 | 2108 |
| IL-21_5540 | A112P, R115D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRDQKHRLECP SCDSYEKKPPKEFLERFKSLLQKMIHQHLSSRTHGSEDS | 1.597 | 2109 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5025 | P107V, A112P, R114G, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGGGQKHRLTCP SCDSYEKKPPKEFLERFKSLLQKMIHQHLSSRTHGSEDS | 1.599 | 2110 |
| IL-21_4920 | A112P, R115G, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRGQKHTLECP SCDSYEKKPPKEFLERFKSLLQKMIHQHLSSRTHGSEDS | 1.606 | 2111 |
| IL-21_5030 | P107V, A112P, R114Q, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGQGQKHRLTCP SCDSYEKKPPKEFLERFKSLLQKMIHQHLSSRTHGSEDS | 1.61 | 2112 |
| IL-21_5510 | R115G, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGRGQKHTLECP SCDSYEKKPPKEFLERFKSLLQKMIHQHLSSRTHGSEDS | 1.614 | 2113 |
| IL-21_5961 | H35F, T110D, A112P, R114Q | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKPPSDNPGQRQKHRLTCP SCDSYEKKPPKEFLERFKSLLQKMIHQHLSSRTHGSEDS | 1.614 | 2114 |
| IL-21_5969 | H35F, P107V, A112P, R114Q | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKVPSTNPGQRQKHRLTCP SCDSYEKKPPKEFLERFKSLLQKMIHQHLSSRTHGSEDS | 1.621 | 2115 |
| IL-21_5349 | N70G, A112P, R114Q, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGQRQKHTLTCP SCDSYEKKPPKEFLERFKSLLQKMIHQHLSSRTHGSEDS | 1.622 | 2116 |
| IL-21_6381 | H35I, I45T, R115G | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKPPSTNAGRGQKHRLTCP SCDSYEKKPPKEFLERFKSLLQKMIHQHLSSRTHGSEDS | 1.622 | 2117 |
| IL-21_5948 | I45T, N70G, K81D, P107V | MRSSPGNMERIVICLMVIFLGTLVHKSSSQGQDRHMIRMRQ LIDTVDQLKNYVNDLVPEFLPAPEDVETGCEWSAFSCFQDA QLKSANTGNNERIINVSIKKLKRKVPSTNAGRRQKHRLTCP SCDSYEKKPPKEFLERFKSLLQKMIHQHLSSRTHGSEDS | 1.623 | 2118 |
| IL-21_6354 | H35I, P107V, R114Q | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKVPSTNAGQRQKHRLTCP SCDSYEKKPPKEFLERFKSLLQKMIHQHLSSRTHGSEDS | 1.632 | 2119 |
| IL-21_5734 | N70G, T110D, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGRRQKHRLECP SCDSYEKKPPKEFLERFKSLLQKMIHQHLSSRTHGSEDS | 1.633 | 2120 |
| IL-21_6251 | I45T, T110D, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSDNAGRGQKHRLTCP SCDSYEKKPPKEFLERFKSLLQKMIHQHLSSRTHGSEDS | 1.633 | 2121 |
| IL-21_4939 | A112P, R114Q, R115G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGQGQKHTLTCP SCDSYEKKPPKEFLERFKSLLQKMIHQHLSSRTHGSEDS | 1.634 | 2122 |
| IL-21_6059 | H35F, I45T, A112P, R115D | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINVSIKKLKRKPPSTNPGRDQKHRLTCP SCDSYEKKPPKEFLERFKSLLQKMIHQHLSSRTHGSEDS | 1.635 | 2123 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_6283 | I45T, N70G, V98E | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINESIKKLKRKPPSTNAGRRQKHRLTCP SCDSYEKKPPKEFLERFKSLLQKMIHQHLSSRTHGSEDS | 1.635 | 2124 |
| IL-21_5345 | N70G, A112P, R114G, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGGRQKDRLTCP SCDSYEKKPPKEFLERFKSLLQKMIHQHLSSRTHGSEDS | 1.638 | 2125 |
| IL-21_5610 | P107V, T110D, R114Q | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGQRQKHRLTCP SCDSYEKKPPKEFLERFKSLLQKMIHQHLSSRTHGSEDS | 1.639 | 2126 |
| IL-21_6340 | H35I, R114Q, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSTNAGQGQKHRLTCP SCDSYEKKPPKEFLERFKSLLQKMIHQHLSSRTHGSEDS | 1.64 | 2127 |
| IL-21_6289 | H35F, A112P, R115G | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKPPSTNPGRGQKHRLTCP SCDSYEKKPPKEFLERFKSLLQKMIHQHLSSRTHGSEDS | 1.641 | 2128 |
| IL-21_5525 | R114Q, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGQRQKHTLECP SCDSYEKKPPKEFLERFKSLLQKMIHQHLSSRTHGSEDS | 1.642 | 2129 |
| IL-21_5653 | V98E, P107V, A112P | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINESIKKLKRKVPSTNPGRRQKHRLTCP SCDSYEKKPPKEFLERFKSLLQKMIHQHLSSRTHGSEDS | 1.643 | 2130 |
| IL-21_5888 | I45T, V98E, P107V, A112P | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKVPSTNPGRRQKHRLTCP SCDSYEKKPPKEFLERFKSLLQKMIHQHLSSRTHGSEDS | 1.643 | 2131 |
| IL-21_6070 | H35F, I45T, P107V, R114Q | MRSSPGNMERIVICLMVIFLGTLVHKSSSQGQDRFMIRMRQ LIDTVDQLKNYVNDLVPEFLPAPEDVETNCEWSAFSCFQKA QLKSANTGNNERIINVSIKKLKRKVPSTNAGQRQKHRLTCP SCDSYEKKPPKEFLERFKSLLQKMIHQHLSSRTHGSEDS | 1.646 | 2132 |
| IL-21_5583 | P107V, R115G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGRGQKHTLTCP SCDSYEKKPPKEFLERFKSLLQKMIHQHLSSRTHGSEDS | 1.648 | 2133 |
| IL-21_5839 | N70G, R115D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRDQKHRLTCP SCDSYEKKPPKEFLERFKSLLQKMIHQHLSSRTHGSEDS | 1.649 | 2134 |
| IL-21_5939 | I45T, N70G, V98E, A112P | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINESIKKLKRKPPSTNPGRRQKHRLTCP SCDSYEKKPPKEFLERFKSLLQKMIHQHLSSRTHGSEDS | 1.65 | 2135 |
| IL-21_5605 | P107V, T110D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGRRQKHTLTCP SCDSYEKKPPKEFLERFKSLLQKMIHQHLSSRTHGSEDS | 1.651 | 2136 |
| IL-21_6097 | H35I, A112P, R114G, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSTNPGGGQKHRLTCP SCDSYEKKPPKEFLERFKSLLQKMIHQHLSSRTHGSEDS | 1.652 | 2137 |
| IL-21_5018 | P107V, A112P, R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGRGQKDRLTCP SCDSYEKKPPKEFLERFKSLLQKMIHQHLSSRTHGSEDS | 1.652 | 2138 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5057 | P107V, T110D, A112P, R114Q | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNPGQRQKHRLTCP SCDSYEKKPPKEFLERFKSLLQKMIHQHLSSRTHGSEDS | 1.653 | 2139 |
| IL-21_6107 | H35I, T110D, A112P, R114G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSDNPGGRQKHRLTCP SCDSYEKKPPKEFLERFKSLLQKMIHQHLSSRTHGSEDS | 1.653 | 2140 |
| IL-21_6377 | H35I, N70G, T110D | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKPPSDNAGRRQKHRLTCP SCDSYEKKPPKEFLERFKSLLQKMIHQHLSSRTHGSEDS | 1.655 | 2141 |
| IL-21_5528 | R114Q, R115G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGQGQKHRLECP SCDSYEKKPPKEFLERFKSLLQKMIHQHLSSRTHGSEDS | 1.656 | 2142 |
| IL-21_5553 | T110D, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRRQKHTLECP SCDSYEKKPPKEFLERFKSLLQKMIHQHLSSRTHGSEDS | 1.657 | 2143 |
| IL-21_5788 | R114Q, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGQGQKHRLTCP SCDSYEKKPPKEFLERFKSLLQKMIHQHLSSRTHGSEDS | 1.658 | 2144 |
| IL-21_6200 | H35I, I45T, R114G, R115G | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKPPSTNAGGGQKHRLTCP SCDSYEKKPPKEFLERFKSLLQKMIHQHLSSRTHGSEDS | 1.658 | 2145 |
| IL-21_5377 | N70G, T110D, A112P, R114G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNPGGRQKHRLTCP SCDSYEKKPPKEFLERFKSLLQKMIHQHLSSRTHGSEDS | 1.66 | 2146 |
| IL-21_5711 | N70G, R115G, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRGQKHRLECP SCDSYEKKPPKEFLERFKSLLQKMIHQHLSSRTHGSEDS | 1.662 | 2147 |
| IL-21_6324 | H35F, N70G, T110D | MRSSPGNMERIVICLMVIFLGTLVHKSSSQGQDRFMIRMRQ LIDIVDQLKNYVNDLVPEFLPAPEDVETGCEWSAFSCFQKA QLKSANTGNNERIINVSIKKLKRKPPSDNAGRRQKHRLTCP SCDSYEKKPPKEFLERFKSLLQKMIHQHLSSRTHGSEDS | 1.662 | 2148 |
| IL-21_5545 | A112P, R114G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGGRQKDRLTCP SCDSYEKKPPKEFLERFKSLLQKMIHQHLSSRTHGSEDS | 1.663 | 2149 |
| IL-21_6349 | H35I, T110D, R114Q | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSDNAGQRQKHRLTCP SCDSYEKKPPKEFLERFKSLLQKMIHQHLSSRTHGSEDS | 1.664 | 2150 |
| IL-21_6291 | H35F, A112P, R114G | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKPPSTNPGGRQKHRLTCP SCDSYEKKPPKEFLERFKSLLQKMIHQHLSSRTHGSEDS | 1.665 | 2151 |
| IL-21_6088 | H35F, I45T, N70G, R115G | MRSSPGNMERIVICLMVIFLGTLVHKSSSQGQDRFMIRMRQ LIDTVDQLKNYVNDLVPEFLPAPEDVETGCEWSAFSCFQKA QLKSANTGNNERIINVSIKKLKRKPPSTNAGRGQKHRLTCP SCDSYEKKPPKEFLERFKSLLQKMIHQHLSSRTHGSEDS | 1.665 | 2152 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5602 | P107V, A112P, R114G | MRSSPGNMERIVICLMVIFLGTLVHKSSSQGQDRHMIRMRQ<br>LIDIVDQLKNYVNDLVPEFLPAPEDVETNCEWSAFSCFQKA<br>QLKSANTGNNERIINVSIKKLKRKVPSTNPGGRQKHRLTCP<br>SCDSYEKKPPKEFLERFKSLLQKMIHQHLSSRTHGSEDS | 1.666 | 2153 |
| IL-21_5520 | R114G, R115G, R119T | MRSSPGNMERIVICLMVIFLGTLVHKSSSQGQDRHMIRMRQ<br>LIDIVDQLKNYVNDLVPEFLPAPEDVETNCEWSAFSCFQKA<br>QLKSANTGNNERIINVSIKKLKRKPPSTNAGGGQKHTLTCP<br>SCDSYEKKPPKEFLERFKSLLQKMIHQHLSSRTHGSEDS | 1.666 | 2154 |
| IL-21_5783 | R114G, R115G | MRSSPGNMERIVICLMVIFLGTLVHKSSSQGQDRHMIRMRQ<br>LIDIVDQLKNYVNDLVPEFLPAPEDVETNCEWSAFSCFQKA<br>QLKSANTGNNERIINVSIKKLKRKPPSTNAGGGQKHRLTCP<br>SCDSYEKKPPKEFLERFKSLLQKMIHQHLSSRTHGSEDS | 1.667 | 2155 |
| IL-21_6237 | H35I, I45T, N70G, R114Q | MRSSPGNMERIVICLMVIFLGTLVHKSSSQGQDRIMIRMRQ<br>LIDTVDQLKNYVNDLVPEFLPAPEDVETGCEWSAFSCFQKA<br>QLKSANTGNNERIINVSIKKLKRKPPSTNAGQRQKHRLTCP<br>SCDSYEKKPPKEFLERFKSLLQKMIHQHLSSRTHGSEDS | 1.667 | 2156 |
| IL-21_6292 | H35F, A112P, R114Q | MRSSPGNMERIVICLMVIFLGTLVHKSSSQGQDREMIRMRQ<br>LIDIVDQLKNYVNDLVPEFLPAPEDVETNCEWSAFSCFQKA<br>QLKSANTGNNERIINVSIKKLKRKPPSTNPGQRQKHRLTCP<br>SCDSYEKKPPKEFLERFKSLLQKMIHQHLSSRTHGSEDS | 1.668 | 2157 |
| IL-21_5379 | N70G, P107V, R119T, T121E | MRSSPGNMERIVICLMVIFLGTLVHKSSSQGQDRHMIRMRQ<br>LIDIVDQLKNYVNDLVPEFLPAPEDVETGCEWSAFSCFQKA<br>QLKSANTGNNERIINVSIKKLKRKVPSTNAGRRQKHTLECP<br>SCDSYEKKPPKEFLERFKSLLQKMIHQHLSSRTHGSEDS | 1.674 | 2158 |
| IL-21_6353 | H35I, P107V, R114G | MRSSPGNMERIVICLMVIFLGTLVHKSSSQGQDRIMIRMRQ<br>LIDIVDQLKNYVNDLVPEFLPAPEDVETNCEWSAFSCFQKA<br>QLKSANTGNNERIINVSIKKLKRKVPSTNAGGRQKHRLTCP<br>SCDSYEKKPPKEFLERFKSLLQKMIHQHLSSRTHGSEDS | 1.677 | 2159 |
| IL-21_5582 | P107V, R115G, T121E | MRSSPGNMERIVICLMVIFLGTLVHKSSSQGQDRHMIRMRQ<br>LIDIVDQLKNYVNDLVPEFLPAPEDVETNCEWSAFSCFQKA<br>QLKSANTGNNERIINVSIKKLKRKVPSTNAGRGQKHRLECP<br>SCDSYEKKPPKEFLERFKSLLQKMIHQHLSSRTHGSEDS | 1.678 | 2160 |
| IL-21_6328 | H35F, I45T, R115G | MRSSPGNMERIVICLMVIFLGTLVHKSSSQGQDREMIRMRQ<br>LIDTVDQLKNYVNDLVPEFLPAPEDVETNCEWSAFSCFQKA<br>QLKSANTGNNERIINVSIKKLKRKPPSTNAGRGQKHRLTCP<br>SCDSYEKKPPKEFLERFKSLLQKMIHQHLSSRTHGSEDS | 1.685 | 2161 |
| IL-21_6069 | H35F, I45T, P107V, R114G | MRSSPGNMERIVICLMVIFLGTLVHKSSSQGQDREMIRMRQ<br>LIDTVDQLKNYVNDLVPEFLPAPEDVETNCEWSAFSCFQKA<br>QLKSANTGNNERIINVSIKKLKRKVPSTNAGGRQKHRLTCP<br>SCDSYEKKPPKEFLERFKSLLQKMIHQHLSSRTHGSEDS | 1.685 | 2162 |
| IL-21_6399 | I45T, K81D | MRSSPGNMERIVICLMVIFLGTLVHKSSSQGQDRHMIRMRQ<br>LIDTVDQLKNYVNDLVPEFLPAPEDVETNCEWSAFSCFQDA<br>QLKSANTGNNERIINVSIKKLKRKPPSTNAGRRQKHRLTCP<br>SCDSYEKKPPKEFLERFKSLLQKMIHQHLSSRTHGSEDS | 1.686 | 2163 |
| IL-21_6206 | H35I, I45T, A112P, R114G | MRSSPGNMERIVICLMVIFLGTLVHKSSSQGQDRIMIRMRQ<br>LIDTVDQLKNYVNDLVPEFLPAPEDVETNCEWSAFSCFQKA<br>QLKSANTGNNERIINVSIKKLKRKPPSTNPGGRQKHRLTCP<br>SCDSYEKKPPKEFLERFKSLLQKMIHQHLSSRTHGSEDS | 1.687 | 2164 |
| IL-21_5574 | T110D, A112P, H118D | MRSSPGNMERIVICLMVIFLGTLVHKSSSQGQDRHMIRMRQ<br>LIDIVDQLKNYVNDLVPEFLPAPEDVETNCEWSAFSCFQKA<br>QLKSANTGNNERIINVSIKKLKRKPPSDNPGRRQKDRLTCP<br>SCDSYEKKPPKEFLERFKSLLQKMIHQHLSSRTHGSEDS | 1.688 | 2165 |
| IL-21_6356 | H35I, P107V, T110D | MRSSPGNMERIVICLMVIFLGTLVHKSSSQGQDRIMIRMRQ<br>LIDIVDQLKNYVNDLVPEFLPAPEDVETNCEWSAFSCFQKA<br>QLKSANTGNNERIINVSIKKLKRKVPSDNAGRRQKHRLTCP<br>SCDSYEKKPPKEFLERFKSLLQKMIHQHLSSRTHGSEDS | 1.688 | 2166 |
| IL-21_4929 | A112P, R114G, R115G, T121E | MRSSPGNMERIVICLMVIFLGTLVHKSSSQGQDRHMIRMRQ<br>LIDIVDQLKNYVNDLVPEFLPAPEDVETNCEWSAFSCFQKA<br>QLKSANTGNNERIINVSIKKLKRKPPSTNPGGGQKHRLECP<br>SCDSYEKKPPKEFLERFKSLLQKMIHQHLSSRTHGSEDS | 1.688 | 2167 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_6108 | H35I, T110D, A112P, R114Q | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSDNPGQRQKHRLTCP SCDSYEKKPPKEFLERFKSLLQKMIHQHLSSRTHGSEDS | 1.689 | 2168 |
| IL-21_5052 | P107V, T110D, A112P, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNPGRRQKHTLTCP SCDSYEKKPPKEFLERFKSLLQKMIHQHLSSRTHGSEDS | 1.692 | 2169 |
| IL-21_6121 | H35I, P107V, T110D, A112P | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKVPSDNPGRRQKHRLTCP SCDSYEKKPPKEFLERFKSLLQKMIHQHLSSRTHGSEDS | 1.692 | 2170 |
| IL-21_6406 | H35F, T110D | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKPPSDNAGRRQKHRLTCP SCDSYEKKPPKEFLERFKSLLQKMIHQHLSSRTHGSEDS | 1.693 | 2171 |
| IL-21_6268 | I45T, V98E, P107V | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKVPSTNAGRRQKHRLTCP SCDSYEKKPPKEFLERFKSLLQKMIHQHLSSRTHGSEDS | 1.695 | 2172 |
| IL-21_5722 | N70G, R114Q, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGQRQKHRLECP SCDSYEKKPPKEFLERFKSLLQKMIHQHLSSRTHGSEDS | 1.695 | 2173 |
| IL-21_5866 | I45T, P107V, T110D, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKVPSDNAGRGQKHRLTCP SCDSYEKKPPKEFLERFKSLLQKMIHQHLSSRTHGSEDS | 1.695 | 2174 |
| IL-21_6239 | H35I, I45T, N70G, T110D | MRSSPGNMERIVICLMVIFLGTLVHKSSSQGQDRIMIRMRQ LIDTVDQLKNYVNDLVPEFLPAPEDVETGCEWSAFSCFQKA QLKSANTGNNERIINVSIKKLKRKPPSDNAGRRQKHRLTCP SCDSYEKKPPKEFLERFKSLLQKMIHQHLSSRTHGSEDS | 1.696 | 2175 |
| IL-21_5750 | N70G, P107V, T110D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSDNAGRRQKHRLTCP SCDSYEKKPPKEFLERFKSLLQKMIHQHLSSRTHGSEDS | 1.696 | 2176 |
| IL-21_5594 | P107V, R114Q, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGQRQKHTLTCP SCDSYEKKPPKEFLERFKSLLQKMIHQHLSSRTHGSEDS | 1.696 | 2177 |
| IL-21_5717 | N70G, R114G, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGGRQKHRLECP SCDSYEKKPPKEFLERFKSLLQKMIHQHLSSRTHGSEDS | 1.698 | 2178 |
| IL-21_6113 | H35I, P107V, A112P, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKVPSTNPGRGQKHRLTCP SCDSYEKKPPKEFLERFKSLLQKMIHQHLSSRTHGSEDS | 1.7 | 2179 |
| IL-21_5931 | I45T, N70G, P107V, R114G | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKVPSTNAGGRQKHRLTCP SCDSYEKKPPKEFLERFKSLLQKMIHQHLSSRTHGSEDS | 1.704 | 2180 |
| IL-21_5842 | N70G, T110D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGRRQKHRLTCP SCDSYEKKPPKEFLERFKSLLQKMIHQHLSSRTHGSEDS | 1.705 | 2181 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5014 | P107V, A112P, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGRRQKDRLECP SCDSYEKKPPKEFLERFKSLLQKMIHQHLSSRTHGSEDS | 1.705 | 2182 |
| IL-21_5567 | T110D, R114Q, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRQKHRLECP SCDSYEKKPPKEFLERFKSLLQKMIHQHLSSRTHGSEDS | 1.706 | 2183 |
| IL-21_6378 | H35I, N70G, P107V | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKVPSTNAGRRQKHRLTCP SCDSYEKKPPKEFLERFKSLLQKMIHQHLSSRTHGSEDS | 1.707 | 2184 |
| IL-21_5554 | T110D, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRRQKDRLECP SCDSYEKKPPKEFLERFKSLLQKMIHQHLSSRTHGSEDS | 1.709 | 2185 |
| IL-21_5802 | T110D, R114G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGGRQKHRLTCP SCDSYEKKPPKEFLERFKSLLQKMIHQHLSSRTHGSEDS | 1.711 | 2186 |
| IL-21_5557 | T110D, R115G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRGQKHTLTCP SCDSYEKKPPKEFLERFKSLLQKMIHQHLSSRTHGSEDS | 1.711 | 2187 |
| IL-21_5846 | I45T, A112P, R114G, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSTNPGGGQKHRLTCP SCDSYEKKPPKEFLERFKSLLQKMIHQHLSSRTHGSEDS | 1.711 | 2188 |
| IL-21_5864 | I45T, P107V, A112P, R114G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKVPSTNPGGRQKHRLTCP SCDSYEKKPPKEFLERFKSLLQKMIHQHLSSRTHGSEDS | 1.713 | 2189 |
| IL-21_6404 | H35F, R114Q | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKPPSTNAGQRQKHRLTCP SCDSYEKKPPKEFLERFKSLLQKMIHQHLSSRTHGSEDS | 1.714 | 2190 |
| IL-21_5778 | R115D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGRDQKHTLTCP SCDSYEKKPPKEFLERFKSLLQKMIHQHLSSRTHGSEDS | 1.719 | 2191 |
| IL-21_6032 | H35F, N70G, T110D, A112P | MRSSPGNMERIVICLMVIFLGTLVHKSSSQGQDREMIRMRQ LIDIVDQLKNYVNDLVPEFLPAPEDVETGCEWSAFSCFQKA QLKSANTGNNERIINVSIKKLKRKPPSDNPGRRQKHRLTCP SCDSYEKKPPKEFLERFKSLLQKMIHQHLSSRTHGSEDS | 1.721 | 2192 |
| IL-21_5016 | P107V, A112P, R115G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGRGQKHRLECP SCDSYEKKPPKEFLERFKSLLQKMIHQHLSSRTHGSEDS | 1.723 | 2193 |
| IL-21_5854 | I45T, T110D, A112P, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSDNPGRGQKHRLTCP SCDSYEKKPPKEFLERFKSLLQKMIHQHLSSRTHGSEDS | 1.724 | 2194 |
| IL-21_5735 | N70G, T110D, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNAGRRQKHTLTCP SCDSYEKKPPKEFLERFKSLLQKMIHQHLSSRTHGSEDS | 1.725 | 2195 |
| IL-21_6277 | I45T, N70G, R115D | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKPPSTNAGRDQKHRLTCP SCDSYEKKPPKEFLERFKSLLQKMIHQHLSSRTHGSEDS | 1.726 | 2196 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_4935 | A112P, R114Q, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGQRQKHTLECP SCDSYEKKPPKEFLERFKSLLQKMIHQHLSSRTHGSEDS | 1.729 | 2197 |
| IL-21_5782 | R114G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGGRQKDRLTCP SCDSYEKKPPKEFLERFKSLLQKMIHQHLSSRTHGSEDS | 1.731 | 2198 |
| IL-21_5579 | P107V, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGRRQKHTLECP SCDSYEKKPPKEFLERFKSLLQKMIHQHLSSRTHGSEDS | 1.731 | 2199 |
| IL-21_5968 | H35F, P107V, A112P, R114G | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKVPSTNPGGRQKHRLTCP SCDSYEKKPPKEFLERFKSLLQKMIHQHLSSRTHGSEDS | 1.732 | 2200 |
| IL-21_6253 | I45T, T110D, R114G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSDNAGGRQKHRLTCP SCDSYEKKPPKEFLERFKSLLQKMIHQHLSSRTHGSEDS | 1.732 | 2201 |
| IL-21_6245 | I45T, R114Q, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSTNAGQGQKHRLTCP SCDSYEKKPPKEFLERFKSLLQKMIHQHLSSRTHGSEDS | 1.733 | 2202 |
| IL-21_5932 | I45T, N70G, P107V, R114Q | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKVPSTNAGQRQKHRLTCP SCDSYEKKPPKEFLERFKSLLQKMIHQHLSSRTHGSEDS | 1.739 | 2203 |
| IL-21_5848 | I45T, A112P, R114Q, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSTNPGQGQKHRLTCP SCDSYEKKPPKEFLERFKSLLQKMIHQHLSSRTHGSEDS | 1.742 | 2204 |
| IL-21_6346 | H35I, T110D, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSDNAGRGQKHRLTCP SCDSYEKKPPKEFLERFKSLLQKMIHQHLSSRTHGSEDS | 1.745 | 2205 |
| IL-21_5856 | I45T, T110D, A112P, R114G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSDNPGGRQKHRLTCP SCDSYEKKPPKEFLERFKSLLQKMIHQHLSSRTHGSEDS | 1.751 | 2206 |
| IL-21_5777 | R115G, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGRGQKDRLTCP SCDSYEKKPPKEFLERFKSLLQKMIHQHLSSRTHGSEDS | 1.752 | 2207 |
| IL-21_5840 | N70G, R114Q | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGQRQKHRLTCP SCDSYEKKPPKEFLERFKSLLQKMIHQHLSSRTHGSEDS | 1.752 | 2208 |
| IL-21_5929 | I45T, N70G, P107V, R115G | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKVPSTNAGRGQKHRLTCP SCDSYEKKPPKEFLERFKSLLQKMIHQHLSSRTHGSEDS | 1.753 | 2209 |
| IL-21_6209 | H35I, I45T, T110D, R115D | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKPPSDNAGRDQKHRLTCP SCDSYEKKPPKEFLERFKSLLQKMIHQHLSSRTHGSEDS | 1.753 | 2210 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_6348 | H35I, T110D, R114G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSDNAGGRQKHRLTCP SCDSYEKKPPKEFLERFKSLLQKMIHQHLSSRTHGSEDS | 1.755 | 2211 |
| IL-21_5546 | A112P, R114G, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGGGQKHRLTCP SCDSYEKKPPKEFLERFKSLLQKMIHQHLSSRTHGSEDS | 1.755 | 2212 |
| IL-21_5562 | T110D, R114G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGGRQKHRLECP SCDSYEKKPPKEFLERFKSLLQKMIHQHLSSRTHGSEDS | 1.758 | 2213 |
| IL-21_5794 | A112P, R115D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRDQKHRLTCP SCDSYEKKPPKEFLERFKSLLQKMIHQHLSSRTHGSEDS | 1.758 | 2214 |
| IL-21_5348 | N70G, A112P, R114Q, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGQRQKHRLECP SCDSYEKKPPKEFLERFKSLLQKMIHQHLSSRTHGSEDS | 1.762 | 2215 |
| IL-21_6061 | H35F, I45T, A112P, R114Q | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINVSIKKLKRKPPSTNPGQRQKHRLTCP SCDSYEKKPPKEFLERFKSLLQKMIHQHLSSRTHGSEDS | 1.771 | 2216 |
| IL-21_5773 | H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGRRQKDRLECP SCDSYEKKPPKEFLERFKSLLQKMIHQHLSSRTHGSEDS | 1.772 | 2217 |
| IL-21_5838 | N70G, R115G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRGQKHRLTCP SCDSYEKKPPKEFLERFKSLLQKMIHQHLSSRTHGSEDS | 1.772 | 2218 |
| IL-21_6301 | H35F, P107V, R114Q | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKVPSTNAGQRQKHRLTCP SCDSYEKKPPKEFLERFKSLLQKMIHQHLSSRTHGSEDS | 1.773 | 2219 |
| IL-21_5747 | N70G, P107V, R114G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGGRQKHRLTCP SCDSYEKKPPKEFLERFKSLLQKMIHQHLSSRTHGSEDS | 1.774 | 2220 |
| IL-21_6392 | I45T, R115D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSTNAGRDQKHRLTCP SCDSYEKKPPKEFLERFKSLLQKMIHQHLSSRTHGSEDS | 1.776 | 2221 |
| IL-21_5593 | P107V, R114Q, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGQRQKHRLECP SCDSYEKKPPKEFLERFKSLLQKMIHQHLSSRTHGSEDS | 1.777 | 2222 |
| IL-21_5403 | N70G, P107V, A112P, R114G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNPGGRQKHRLTCP SCDSYEKKPPKEFLERFKSLLQKMIHQHLSSRTHGSEDS | 1.779 | 2223 |
| IL-21_4978 | T110D, A112P, R114G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGGRQKHRLECP SCDSYEKKPPKEFLERFKSLLQKMIHQHLSSRTHGSEDS | 1.779 | 2224 |
| IL-21_6303 | H35F, P107V, T110D | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKVPSDNAGRRQKHRLTCP SCDSYEKKPPKEFLERFKSLLQKMIHQHLSSRTHGSEDS | 1.783 | 2225 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5013 | P107V, A112P, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGRRQKHTLECP SCDSYEKKPPKEFLERFKSLLQKMIHQHLSSRTHGSEDS | 1.786 | 2226 |
| IL-21_6345 | H35I, A112P, R114Q | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSTNPGQRQKHRLTCP SCDSYEKKPPKEFLERFKSLLQKMIHQHLSSRTHGSEDS | 1.787 | 2227 |
| IL-21_5399 | N70G, P107V, A112P, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNPGRRQKHTLTCP SCDSYEKKPPKEFLERFKSLLQKMIHQHLSSRTHGSEDS | 1.79 | 2228 |
| IL-21_5404 | N70G, P107V, A112P, R114Q | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNPGQRQKHRLTCP SCDSYEKKPPKEFLERFKSLLQKMIHQHLSSRTHGSEDS | 1.792 | 2229 |
| IL-21_5516 | R114G, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGGRQKHTLECP SCDSYEKKPPKEFLERFKSLLQKMIHQHLSSRTHGSEDS | 1.792 | 2230 |
| IL-21_5556 | T110D, R115G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRGQKHRLECP SCDSYEKKPPKEFLERFKSLLQKMIHQHLSSRTHGSEDS | 1.793 | 2231 |
| IL-21_5051 | P107V, T110D, A112P, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNPGRRQKHRLECP SCDSYEKKPPKEFLERFKSLLQKMIHQHLSSRTHGSEDS | 1.795 | 2232 |
| IL-21_5536 | A112P, H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRRQKDTLTCP SCDSYEKKPPKEFLERFKSLLQKMIHQHLSSRTHGSEDS | 1.798 | 2233 |
| IL-21_6330 | H35F, I45T, R114G | MRSSPGNMERIVICLMVIFLGTLVHKSSSQGQDRFMIRMRQ LIDTVDQLKNYVNDLVPEFLPAPEDVETNCEWSAFSCFQKA QLKSANTGNNERIINVSIKKLKRKPPSTNAGGRQKHRLTCP SCDSYEKKPPKEFLERFKSLLQKMIHQHLSSRTHGSEDS | 1.803 | 2234 |
| IL-21_6384 | H351, I45T, R114Q | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKPPSTNAGQRQKHRLTCP SCDSYEKKPPKEFLERFKSLLQKMIHQHLSSRTHGSEDS | 1.804 | 2235 |
| IL-21_5807 | P107V, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGRRQKDRLTCP SCDSYEKKPPKEFLERFKSLLQKMIHQHLSSRTHGSEDS | 1.808 | 2236 |
| IL-21_5575 | T110D, A112P, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGRGQKHRLTCP SCDSYEKKPPKEFLERFKSLLQKMIHQHLSSRTHGSEDS | 1.809 | 2237 |
| IL-21_2896 | R115D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGRDQKHRLECP SCDSYEKKPPKEFLERFKSLLQKMIHQHLSSRTHGSEDS | 1.81 | 2238 |
| IL-21_6072 | H35F, I45T, P107V, T110D | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINVSIKKLKRKVPSDNAGRRQKHRLTCP SCDSYEKKPPKEFLERFKSLLQKMIHQHLSSRTHGSEDS | 1.81 | 2239 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5334 | N70G, A112P, R119T, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGRRQKHTLECP SCDSYEKKPPKEFLERFKSLLQKMIHQHLSSRTHGSEDS | 1.814 | 2240 |
| IL-21_6297 | H35F, T110D, A112P | MRSSPGNMERIVICLMVIFLGTLVHKSSSQGQDREMIRMRQ LIDIVDQLKNYVNDLVPEFLPAPEDVETNCEWSAFSCFQKA QLKSANTGNNERIINVSIKKLKRKPPSDNPGRRQKHRLTCP SCDSYEKKPPKEFLERFKSLLQKMIHQHLSSRTHGSEDS | 1.817 | 2241 |
| IL-21_5604 | P107V, T110D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGRRQKHRLECP SCDSYEKKPPKEFLERFKSLLQKMIHQHLSSRTHGSEDS | 1.817 | 2242 |
| IL-21_5519 | R114G, R115G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGGGQKHRLECP SCDSYEKKPPKEFLERFKSLLQKMIHQHLSSRTHGSEDS | 1.817 | 2243 |
| IL-21_6266 | I45T, V98E, A112P | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKPPSTNPGRRQKHRLTCP SCDSYEKKPPKEFLERFKSLLQKMIHQHLSSRTHGSEDS | 1.819 | 2244 |
| IL-21_5808 | P107V, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGRGQKHRLTCP SCDSYEKKPPKEFLERFKSLLQKMIHQHLSSRTHGSEDS | 1.819 | 2245 |
| IL-21_5743 | N70G, P107V, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGRRQKHTLTCP SCDSYEKKPPKEFLERFKSLLQKMIHQHLSSRTHGSEDS | 1.822 | 2246 |
| IL-21_5538 | A112P, R115G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRGQKHTLTCP SCDSYEKKPPKEFLERFKSLLQKMIHQHLSSRTHGSEDS | 1.824 | 2247 |
| IL-21_5022 | P107V, A112P, R114G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGGRQKHRLECP SCDSYEKKPPKEFLERFKSLLQKMIHQHLSSRTHGSEDS | 1.825 | 2248 |
| IL-21_6323 | H35F, N70G, A112P | MRSSPGNMERIVICLMVIFLGTLVHKSSSQGQDREMIRMRQ LIDIVDQLKNYVNDLVPEFLPAPEDVETGCEWSAFSCFQKA QLKSANTGNNERIINVSIKKLKRKPPSTNPGRRQKHRLTCP SCDSYEKKPPKEFLERFKSLLQKMIHQHLSSRTHGSEDS | 1.826 | 2249 |
| IL-21_5577 | T110D, A112P, R114G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGGRQKHRLTCP SCDSYEKKPPKEFLERFKSLLQKMIHQHLSSRTHGSEDS | 1.826 | 2250 |
| IL-21_4983 | T110D, A112P, R114Q, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGQRQKHRLECP SCDSYEKKPPKEFLERFKSLLQKMIHQHLSSRTHGSEDS | 1.829 | 2251 |
| IL-21_6207 | H35I, I45T, A112P, R114Q | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKPPSTNPGQRQKHRLTCP SCDSYEKKPPKEFLERFKSLLQKMIHQHLSSRTHGSEDS | 1.83 | 2252 |
| IL-21_6093 | H35F, I45T, N70G, T110D | MRSSPGNMERIVICLMVIFLGTLVHKSSSQGQDREMIRMRQ LIDTVDQLKNYVNDLVPEFLPAPEDVETGCEWSAFSCFQKA QLKSANTGNNERIINVSIKKLKRKPPSDNAGRRQKHRLTCP SCDSYEKKPPKEFLERFKSLLQKMIHQHLSSRTHGSEDS | 1.83 | 2253 |
| IL-21_6204 | H35I, I45T, A112P, R115G | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKPPSTNPGRGQKHRLTCP SCDSYEKKPPKEFLERFKSLLQKMIHQHLSSRTHGSEDS | 1.836 | 2254 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5974 | H35F, P107V, T110D, A112P | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKVPSDNPGRRQKHRLTCP SCDSYEKKPPKEFLERFKSLLQKMIHQHLSSRTHGSEDS | 1.837 | 2255 |
| IL-21_2726 | N70G, R114G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGGRQKHRLTCP SCDSYEKKPPKEFLERFKSLLQKMIHQHLSSRTHGSEDS | 1.837 | 2256 |
| IL-21_6067 | H35F, I45T, P107V, R115G | MRSSPGNMERIVICLMVIFLGTLVHKSSSQGQDRFMIRMRQ LIDTVDQLKNYVNDLVPEFLPAPEDVETNCEWSAFSCFQKA QLKSANTGNNERIINVSIKKLKRKVPSTNAGRGQKHRLTCP SCDSYEKKPPKEFLERFKSLLQKMIHQHLSSRTHGSEDS | 1.839 | 2257 |
| IL-21_5742 | N70G, P107V, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGRRQKHRLECP SCDSYEKKPPKEFLERFKSLLQKMIHQHLSSRTHGSEDS | 1.842 | 2258 |
| IL-21_6374 | H35I, N70G, R114G | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKPPSTNAGGRQKHRLTCP SCDSYEKKPPKEFLERFKSLLQKMIHQHLSSRTHGSEDS | 1.853 | 2259 |
| IL-21_5803 | T110D, R114Q | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGQRQKHRLTCP SCDSYEKKPPKEFLERFKSLLQKMIHQHLSSRTHGSEDS | 1.855 | 2260 |
| IL-21_5837 | N70G, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRRQKDRLTCP SCDSYEKKPPKEFLERFKSLLQKMIHQHLSSRTHGSEDS | 1.856 | 2261 |
| IL-21_5787 | R114Q, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGQRQKDRLTCP SCDSYEKKPPKEFLERFKSLLQKMIHQHLSSRTHGSEDS | 1.858 | 2262 |
| IL-21_6058 | H35F, I45T, A112P, R115G | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINVSIKKLKRKPPSTNPGRGQKHRLTCP SCDSYEKKPPKEFLERFKSLLQKMIHQHLSSRTHGSEDS | 1.861 | 2263 |
| IL-21_5922 | I45T, N70G, A112P, R114G | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKPPSTNPGGRQKHRLTCP SCDSYEKKPPKEFLERFKSLLQKMIHQHLSSRTHGSEDS | 1.866 | 2264 |
| IL-21_6060 | H35F, I45T, A112P, R114G | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINVSIKKLKRKPPSTNPGGRQKHRLTCP SCDSYEKKPPKEFLERFKSLLQKMIHQHLSSRTHGSEDS | 1.866 | 2265 |
| IL-21_6300 | H35F, P107V, R114G | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKVPSTNAGGRQKHRLTCP SCDSYEKKPPKEFLERFKSLLQKMIHQHLSSRTHGSEDS | 1.867 | 2266 |
| IL-21_5343 | N70G, A112P, R114G, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGGRQKHRLECP SCDSYEKKPPKEFLERFKSLLQKMIHQHLSSRTHGSEDS | 1.869 | 2267 |
| IL-21_5027 | P107V, A112P, R114Q, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGQRQKHRLECP SCDSYEKKPPKEFLERFKSLLQKMIHQHLSSRTHGSEDS | 1.87 | 2268 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5923 | I45T, N70G, A112P, R114Q | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKPPSTNPGQRQKHRLTCP SCDSYEKKPPKEFLERFKSLLQKMIHQHLSSRTHGSEDS | 1.875 | 2269 |
| IL-21_5549 | A112P, R114Q, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGQRQKHTLTCP SCDSYEKKPPKEFLERFKSLLQKMIHQHLSSRTHGSEDS | 1.876 | 2270 |
| IL-21_5799 | T110D, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRRQKDRLTCP SCDSYEKKPPKEFLERFKSLLQKMIHQHLSSRTHGSEDS | 1.88 | 2271 |
| IL-21_5813 | P107V, T110D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNAGRRQKHRLTCP SCDSYEKKPPKEFLERFKSLLQKMIHQHLSSRTHGSEDS | 1.881 | 2272 |
| IL-21_6183 | H35I, N70G, P107V, A112P | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKVPSTNPGRRQKHRLTCP SCDSYEKKPPKEFLERFKSLLQKMIHQHLSSRTHGSEDS | 1.881 | 2273 |
| IL-21_5733 | N70G, A112P, R114Q | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGQRQKHRLTCP SCDSYEKKPPKEFLERFKSLLQKMIHQHLSSRTHGSEDS | 1.885 | 2274 |
| IL-21_6213 | H35I, I45T, P107V, R115G | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKVPSTNAGRGQKHRLTCP SCDSYEKKPPKEFLERFKSLLQKMIHQHLSSRTHGSEDS | 1.885 | 2275 |
| IL-21_5372 | N70G, T110D, A112P, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNPGRRQKHRLECP SCDSYEKKPPKEFLERFKSLLQKMIHQHLSSRTHGSEDS | 1.887 | 2276 |
| IL-21_6218 | H35I, I45T, P107V, T110D | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKVPSDNAGRRQKHRLTCP SCDSYEKKPPKEFLERFKSLLQKMIHQHLSSRTHGSEDS | 1.888 | 2277 |
| IL-21_5730 | N70G, A112P, R115G | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGRGQKHRLTCP SCDSYEKKPPKEFLERFKSLLQKMIHQHLSSRTHGSEDS | 1.889 | 2278 |
| IL-21_5744 | N70G, P107V, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGRRQKDRLTCP SCDSYEKKPPKEFLERFKSLLQKMIHQHLSSRTHGSEDS | 1.892 | 2279 |
| IL-21_6243 | I45T, R114G, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSTNAGGGQKHRLTCP SCDSYEKKPPKEFLERFKSLLQKMIHQHLSSRTHGSEDS | 1.893 | 2280 |
| IL-21_5810 | P107V, R114G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGGRQKHRLTCP SCDSYEKKPPKEFLERFKSLLQKMIHQHLSSRTHGSEDS | 1.898 | 2281 |
| IL-21_5729 | N70G, A112P, H118D | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGRRQKDRLTCP SCDSYEKKPPKEFLERFKSLLQKMIHQHLSSRTHGSEDS | 1.91 | 2282 |
| IL-21_6383 | H35I, I45T, R114G | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKPPSTNAGGRQKHRLTCP SCDSYEKKPPKEFLERFKSLLQKMIHQHLSSRTHGSEDS | 1.912 | 2283 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_6215 | H35I, I45T, P107V, R114G | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKVPSTNAGGRQKHRLTCP SCDSYEKKPPKEFLERFKSLLQKMIHQHLSSRTHGSEDS | 1.914 | 2284 |
| IL-21_6278 | I45T, N70G, R114G | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKPPSTNAGGRQKHRLTCP SCDSYEKKPPKEFLERFKSLLQKMIHQHLSSRTHGSEDS | 1.916 | 2285 |
| IL-21_5550 | A112P, R114Q, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGQRQKDRLTCP SCDSYEKKPPKEFLERFKSLLQKMIHQHLSSRTHGSEDS | 1.916 | 2286 |
| IL-21_6415 | H35I, R114Q | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKPPSTNAGRQKHRLTCP SCDSYEKKPPKEFLERFKSLLQKMIHQHLSSRTHGSEDS | 1.917 | 2287 |
| IL-21_5785 | R114Q, T121E | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSTNAGRQKHRLECP SCDSYEKKPPKEFLERFKSLLQKMIHQHLSSRTHGSEDS | 1.917 | 2288 |
| IL-21_5578 | T110D, A112P, R114Q | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSDNPGQRQKHRLTCP SCDSYEKKPPKEFLERFKSLLQKMIHQHLSSRTHGSEDS | 1.918 | 2289 |
| IL-21_6256 | I45T, P107V, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKVPSTNAGRGQKHRLTCP SCDSYEKKPPKEFLERFKSLLQKMIHQHLSSRTHGSEDS | 1.921 | 2290 |
| IL-21_5870 | I45T, P107V, T110D, A112P | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKVPSDNPGRRQKHRLTCP SCDSYEKKPPKEFLERFKSLLQKMIHQHLSSRTHGSEDS | 1.923 | 2291 |
| IL-21_5551 | A112P, R114Q, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSTNPGQGQKHRLTCP SCDSYEKKPPKEFLERFKSLLQKMIHQHLSSRTHGSEDS | 1.925 | 2292 |
| IL-21_5599 | P107V, A112P, H118D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKVPSTNPGRRQKDRLTCP SCDSYEKKPPKEFLERFKSLLQKMIHQHLSSRTHGSEDS | 1.926 | 2293 |
| IL-21_5865 | I45T, P107V, A112P, R114Q | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKVPSTNPGQRQKHRLTCP SCDSYEKKPPKEFLERFKSLLQKMIHQHLSSRTHGSEDS | 1.927 | 2294 |
| IL-21_6212 | H35I, I45T, T110D, A112P | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKPPSDNPGRRQKHRLTCP SCDSYEKKPPKEFLERFKSLLQKMIHQHLSSRTHGSEDS | 1.934 | 2295 |
| IL-21_5412 | N70G, P107V, T110D, A112P | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSDNPGRRQKHRLTCP SCDSYEKKPPKEFLERFKSLLQKMIHQHLSSRTHGSEDS | 1.935 | 2296 |
| IL-21_5600 | P107V, A112P, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGRGQKHRLTCP SCDSYEKKPPKEFLERFKSLLQKMIHQHLSSRTHGSEDS | 1.936 | 2297 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_4969 | T110D, A112P, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGRRQKHTLECP SCDSYEKKPPKEFLERFKSLLQKMIHQHLSSRTHGSEDS | 1.947 | 2298 |
| IL-21_5862 | I45T, P107V, A112P, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKVPSTNPGRGQKHRLTCP SCDSYEKKPPKEFLERFKSLLQKMIHQHLSSRTHGSEDS | 1.952 | 2299 |
| IL-21_6248 | I45T, A112P, R115D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSTNPGRDQKHRLTCP SCDSYEKKPPKEFLERFKSLLQKMIHQHLSSRTHGSEDS | 1.953 | 2300 |
| IL-21_6350 | H35I, T110D, A112P | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSDNPGRRQKHRLTCP SCDSYEKKPPKEFLERFKSLLQKMIHQHLSSRTHGSEDS | 1.957 | 2301 |
| IL-21_5573 | T110D, A112P, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGRRQKHTLTCP SCDSYEKKPPKEFLERFKSLLQKMIHQHLSSRTHGSEDS | 1.96 | 2302 |
| IL-21_6398 | I45T, V98E | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINESIKKLKRKPPSTNAGRRQKHRLTCP SCDSYEKKPPKEFLERFKSLLQKMIHQHLSSRTHGSEDS | 1.96 | 2303 |
| IL-21_5537 | A112P, R115G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRGQKHRLECP SCDSYEKKPPKEFLERFKSLLQKMIHQHLSSRTHGSEDS | 1.962 | 2304 |
| IL-21_5708 | N70G, R119T, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRRQKHTLECP SCDSYEKKPPKEFLERFKSLLQKMIHQHLSSRTHGSEDS | 1.964 | 2305 |
| IL-21_6386 | H351, I45T, T110D | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKPPSDNAGRRQKHRLTCP SCDSYEKKPPKEFLERFKSLLQKMIHQHLSSRTHGSEDS | 1.97 | 2306 |
| IL-21_5544 | A112P, R114G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGGRQKHTLTCP SCDSYEKKPPKEFLERFKSLLQKMIHQHLSSRTHGSEDS | 1.971 | 2307 |
| IL-21_6331 | H35F, I45T, R114Q | MRSSPGNMERIVICLMVIFLGTLVHKSSSQGQDRFMIRMRQ LIDTVDQLKNYVNDLVPEFLPAPEDVETNCEWSAFSCFQKA QLKSANTGNNERIINVSIKKLKRKPPSTNAGQRQKHRLTCP SCDSYEKKPPKEFLERFKSLLQKMIHQHLSSRTHGSEDS | 1.971 | 2308 |
| IL-21_6410 | H35F, N70G | MRSSPGNMERIVICLMVIFLGTLVHKSSSQGQDRFMIRMRQ LIDIVDQLKNYVNDLVPEFLPAPEDVETGCEWSAFSCFQKA QLKSANTGNNERIINVSIKKLKRKPPSTNAGRRQKHRLTCP SCDSYEKKPPKEFLERFKSLLQKMIHQHLSSRTHGSEDS | 1.974 | 2309 |
| IL-21_6254 | I45T, T110D, R114Q | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSDNAGQRQKHRLTCP SCDSYEKKPPKEFLERFKSLLQKMIHQHLSSRTHGSEDS | 1.982 | 2310 |
| IL-21_5535 | A112P, H118D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRRQKDRLECP SCDSYEKKPPKEFLERFKSLLQKMIHQHLSSRTHGSEDS | 1.992 | 2311 |
| IL-21_5741 | N70G, T110D, A112P | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSDNPGRRQKHRLTCP SCDSYEKKPPKEFLERFKSLLQKMIHQHLSSRTHGSEDS | 1.998 | 2312 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5920 | I45T, N70G, A112P, R115G | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKPPSTNPGRGQKHRLTCP SCDSYEKKPPKEFLERFKSLLQKMIHQHLSSRTHGSEDS | 2 | 2313 |
| IL-21_5611 | P107V, T110D, A112P | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSDNPGRRQKHRLTCP SCDSYEKKPPKEFLERFKSLLQKMIHQHLSSRTHGSEDS | 2.006 | 2314 |
| IL-21_6344 | H35I, A112P, R114G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSTNPGGRQKHRLTCP SCDSYEKKPPKEFLERFKSLLQKMIHQHLSSRTHGSEDS | 2.012 | 2315 |
| IL-21_6421 | H35I, N70G | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKPPSTNAGRRQKHRLTCP SCDSYEKKPPKEFLERFKSLLQKMIHQHLSSRTHGSEDS | 2.014 | 2316 |
| IL-21_5786 | R114Q, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGQRQKHTLTCP SCDSYEKKPPKEFLERFKSLLQKMIHQHLSSRTHGSEDS | 2.015 | 2317 |
| IL-21_6407 | H35F, P107V | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKVPSTNAGRRQKHRLTCP SCDSYEKKPPKEFLERFKSLLQKMIHQHLSSRTHGSEDS | 2.015 | 2318 |
| IL-21_5774 | H118D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGRRQKDTLTCP SCDSYEKKPPKEFLERFKSLLQKMIHQHLSSRTHGSEDS | 2.023 | 2319 |
| IL-21_6325 | H35F, N70G, P107V | MRSSPGNMERIVICLMVIFLGTLVHKSSSQGQDREMIRMRQ LIDIVDQLKNYVNDLVPEFLPAPEDVETGCEWSAFSCFQKA QLKSANTGNNERIINVSIKKLKRKVPSTNAGRRQKHRLTCP SCDSYEKKPPKEFLERFKSLLQKMIHQHLSSRTHGSEDS | 2.024 | 2320 |
| IL-21_6281 | I45T, N70G, T110D | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKPPSDNAGRRQKHRLTCP SCDSYEKKPPKEFLERFKSLLQKMIHQHLSSRTHGSEDS | 2.028 | 2321 |
| IL-21_5934 | I45T, N70G, P107V, T110D | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKVPSDNAGRRQKHRLTCP SCDSYEKKPPKEFLERFKSLLQKMIHQHLSSRTHGSEDS | 2.033 | 2322 |
| IL-21_6279 | I45T, N70G, R114Q | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKPPSTNAGQRQKHRLTCP SCDSYEKKPPKEFLERFKSLLQKMIHQHLSSRTHGSEDS | 2.041 | 2323 |
| IL-21_6240 | H351, I45T, N70G, P107V | MRSSPGNMERIVICLMVIFLGTLVHKSSSQGQDRIMIRMRQ LIDTVDQLKNYVNDLVPEFLPAPEDVETGCEWSAFSCFQKA QLKSANTGNNERIINVSIKKLKRKVPSTNAGRRQKHRLTCP SCDSYEKKPPKEFLERFKSLLQKMIHQHLSSRTHGSEDS | 2.063 | 2324 |
| IL-21_5798 | T110D, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRRQKHTLTCP SCDSYEKKPPKEFLERFKSLLQKMIHQHLSSRTHGSEDS | 2.063 | 2325 |
| IL-21_5811 | P107V, R114Q | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGQRQKHRLTCP SCDSYEKKPPKEFLERFKSLLQKMIHQHLSSRTHGSEDS | 2.071 | 2326 |
| IL-21_5603 | P107V, A112P, R114Q | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGQRQKHRLTCP SCDSYEKKPPKEFLERFKSLLQKMIHQHLSSRTHGSEDS | 2.072 | 2327 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5775 | R115G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGRGQKHRLECP SCDSYEKKPPKEFLERFKSLLQKMIHQHLSSRTHGSEDS | 2.073 | 2328 |
| IL-21_6376 | H35I, N70G, A112P | MRSSPGNMERIVICLMVIFLGTLVHKSSSQGQDRIMIRMRQ LIDIVDQLKNYVNDLVPEFLPAPEDVETGCEWSAFSCFQKA QLKSANTGNNERIINVSIKKLKRKPPSTNPGRRQKHRLTCP SCDSYEKKPPKEFLERFKSLLQKMIHQHLSSRTHGSEDS | 2.074 | 2329 |
| IL-21_5749 | N70G, P107V, A112P | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNPGRRQKHRLTCP SCDSYEKKPPKEFLERFKSLLQKMIHQHLSSRTHGSEDS | 2.078 | 2330 |
| IL-21_5543 | A112P, R114G T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGGRQKHRLECP SCDSYEKKPPKEFLERFKSLLQKMIHQHLSSRTHGSEDS | 2.081 | 2331 |
| IL-21_6337 | H35F, I45T, N70G | MRSSPGNMERIVICLMVIFLGTLVHKSSSQGQDRFMIRMRQ LIDTVDQLKNYVNDLVPEFLPAPEDVETGCEWSAFSCFQKA QLKSANTGNNERIINVSIKKLKRKPPSTNAGRRQKHRLTCP SCDSYEKKPPKEFLERFKSLLQKMIHQHLSSRTHGSEDS | 2.089 | 2332 |
| IL-21_5792 | A112P, H118D | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRRQKDRLTCP SCDSYEKKPPKEFLERFKSLLQKMIHQHLSSRTHGSEDS | 2.099 | 2333 |
| IL-21_6258 | I45T, P107V, R114G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKVPSTNAGGRQKHRLTCP SCDSYEKKPPKEFLERFKSLLQKMIHQHLSSRTHGSEDS | 2.108 | 2334 |
| IL-21_6092 | H35F, I45T, N70G, A112P | MRSSPGNMERIVICLMVIFLGTLVHKSSSQGQDRFMIRMRQ LIDTVDQLKNYVNDLVPEFLPAPEDVETGCEWSAFSCFQKA QLKSANTGNNERIINVSIKKLKRKPPSTNPGRRQKHRLTCP SCDSYEKKPPKEFLERFKSLLQKMIHQHLSSRTHGSEDS | 2.109 | 2335 |
| IL-21_6302 | H35F, P107V, A112P | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKVPSTNPGRRQKHRLTCP SCDSYEKKPPKEFLERFKSLLQKMIHQHLSSRTHGSEDS | 2.12 | 2336 |
| IL-21_5843 | N70G, P107V | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNAGRRQKHRLTCP SCDSYEKKPPKEFLERFKSLLQKMIHQHLSSRTHGSEDS | 2.127 | 2337 |
| IL-21_6412 | H35I, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSTNAGRGQKHRLTCP SCDSYEKKPPKEFLERFKSLLQKMIHQHLSSRTHGSEDS | 2.135 | 2338 |
| IL-21_6066 | H35F, I45T, T110D, A112P | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINVSIKKLKRKPPSDNPGRRQKHRLTCP SCDSYEKKPPKEFLERFKSLLQKMIHQHLSSRTHGSEDS | 2.138 | 2339 |
| IL-21_5836 | N70G, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRRQKHTLTCP SCDSYEKKPPKEFLERFKSLLQKMIHQHLSSRTHGSEDS | 2.144 | 2340 |
| IL-21_5806 | P107V, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGRRQKHTLTCP SCDSYEKKPPKEFLERFKSLLQKMIHQHLSSRTHGSEDS | 2.15 | 2341 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_6094 | H35F, I45T, N07G, P107V | MRSSPGNMERIVICLMVIFLGTLVHKSSSQGQDREMIRMRQ LIDTVDQLKNYVNDLVPEFLPAPEDVETGCEWSAFSCFQKA QLKSANTGNNERIINVSIKKLKRKVPSTNAGRRQKHRLTCP SCDSYEKKPPKEFLERFKSLLQKMIHQHLSSRTHGSEDS | 2.155 | 2342 |
| IL-21_6249 | I45T, A112P, R114G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSTNPGGRQKHRLTCP SCDSYEKKPPKEFLERFKSLLQKMIHQHLSSRTHGSEDS | 2.165 | 2343 |
| IL-21_5598 | P107V, A112P, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGRRQKHTLTCP SCDSYEKKPPKEFLERFKSLLQKMIHQHLSSRTHGSEDS | 2.167 | 2344 |
| IL-21_6234 | H35I, I45T, N70G, R115G | MRSSPGNMERIVICLMVIFLGTLVHKSSSQGQDRIMIRMRQ LIDTVDQLKNYVNDLVPEFLPAPEDVETGCEWSAFSCFQKA QLKSANTGNNERIINVSIKKLKRKPPSTNAGRGQKHRLTCP SCDSYEKKPPKEFLERFKSLLQKMIHQHLSSRTHGSEDS | 2.168 | 2345 |
| IL-21_5835 | N70G, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNAGRRQKHRLECP SCDSYEKKPPKEFLERFKSLLQKMIHQHLSSRTHGSEDS | 2.18 | 2346 |
| IL-21_6387 | H35I, I45T, P107V | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKVPSTNAGRRQKHRLTCP SCDSYEKKPPKEFLERFKSLLQKMIHQHLSSRTHGSEDS | 2.192 | 2347 |
| IL-21_5548 | A112P, R114Q, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGQRQKHRLECP SCDSYEKKPPKEFLERFKSLLQKMIHQHLSSRTHGSEDS | 2.193 | 2348 |
| IL-21_5780 | R114G, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGGRQKHRLECP SCDSYEKKPPKEFLERFKSLLQKMIHQHLSSRTHGSEDS | 2.193 | 2349 |
| IL-21_5597 | P107V, A112P, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNPGRRQKHRLECP SCDSYEKKPPKEFLERFKSLLQKMIHQHLSSRTHGSEDS | 2.203 | 2350 |
| IL-21_6037 | H35F, N70G, P107V, A112P | MRSSPGNMERIVICLMVIFLGTLVHKSSSQGQDRFMIRMRQ LIDIVDQLKNYVNDLVPEFLPAPEDVETGCEWSAFSCFQKA QLKSANTGNNERIINVSIKKLKRKVPSTNPGRRQKHRLTCP SCDSYEKKPPKEFLERFKSLLQKMIHQHLSSRTHGSEDS | 2.207 | 2351 |
| IL-21_6414 | H35I, R114G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSTNAGGRQKHRLTCP SCDSYEKKPPKEFLERFKSLLQKMIHQHLSSRTHGSEDS | 2.214 | 2352 |
| IL-21_6276 | I45T, N70G, R115G | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKPPSTNAGRGQKHRLTCP SCDSYEKKPPKEFLERFKSLLQKMIHQHLSSRTHGSEDS | 2.214 | 2353 |
| IL-21_6259 | I45T, P107V, R114Q | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKVPSTNAGQRQKHRLTCP SCDSYEKKPPKEFLERFKSLLQKMIHQHLSSRTHGSEDS | 2.22 | 2354 |
| IL-21_5572 | T110D, A112P, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGRRQKHRLECP SCDSYEKKPPKEFLERFKSLLQKMIHQHLSSRTHGSEDS | 2.227 | 2355 |
| IL-21_6282 | I45T, N70G, P107V | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKVPSTNAGRRQKHRLTCP SCDSYEKKPPKEFLERFKSLLQKMIHQHLSSRTHGSEDS | 2.232 | 2356 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_5398 | N70G, P107V, A112P, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKVPSTNPGRRQKHRLECP SCDSYEKKPPKEFLERFKSLLQKMIHQHLSSRTHGSEDS | 2.236 | 2357 |
| IL-21_6333 | H35F, I45T, T110D | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINVSIKKLKRKPPSDNAGRRQKHRLTCP SCDSYEKKPPKEFLERFKSLLQKMIHQHLSSRTHGSEDS | 2.244 | 2358 |
| IL-21_5728 | N70G, A112P, R119T | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGRRQKHTLTCP SCDSYEKKPPKEFLERFKSLLQKMIHQHLSSRTHGSEDS | 2.245 | 2359 |
| IL-21_6261 | I45T, P107V, T110D | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKVPSDNAGRRQKHRLTCP SCDSYEKKPPKEFLERFKSLLQKMIHQHLSSRTHGSEDS | 2.245 | 2360 |
| IL-21_5534 | A112P, R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRRQKHTLECP SCDSYEKKPPKEFLERFKSLLQKMIHQHLSSRTHGSEDS | 2.252 | 2361 |
| IL-21_6390 | H35I, I45T, N70G | MRSSPGNMERIVICLMVIFLGTLVHKSSSQGQDRIMIRMRQ LIDTVDQLKNYVNDLVPEFLPAPEDVETGCEWSAFSCFQKA QLKSANTGNNERIINVSIKKLKRKPPSTNAGRRQKHRLTCP SCDSYEKKPPKEFLERFKSLLQKMIHQHLSSRTHGSEDS | 2.259 | 2362 |
| IL-21_6405 | H35F, A112P | MRSSPGNMERIVICLMVIFLGTLVHKSSSQGQDRFMIRMRQ LIDIVDQLKNYVNDLVPEFLPAPEDVETNCEWSAFSCFQKA QLKSANTGNNERIINVSIKKLKRKPPSTNPGRRQKHRLTCP SCDSYEKKPPKEFLERFKSLLQKMIHQHLSSRTHGSEDS | 2.259 | 2363 |
| IL-21_6250 | I45T, A112P, R114Q | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSTNPGQRQKHRLTCP SCDSYEKKPPKEFLERFKSLLQKMIHQHLSSRTHGSEDS | 2.261 | 2364 |
| IL-21_5805 | P107V, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKVPSTNAGRRQKHRLECP SCDSYEKKPPKEFLERFKSLLQKMIHQHLSSRTHGSEDS | 2.263 | 2365 |
| IL-21_6342 | H35I, A112P, R115G | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSTNPGRGQKHRLTCP SCDSYEKKPPKEFLERFKSLLQKMIHQHLSSRTHGSEDS | 2.269 | 2366 |
| IL-21_6247 | I45T, A112P, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSTNPGRGQKHRLTCP SCDSYEKKPPKEFLERFKSLLQKMIHQHLSSRTHGSEDS | 2.272 | 2367 |
| IL-21_5793 | A112P, R115G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRGQKHRLTCP SCDSYEKKPPKEFLERFKSLLQKMIHQHLSSRTHGSEDS | 2.273 | 2368 |
| IL-21_5772 | R119T, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGRRQKHTLECP SCDSYEKKPPKEFLERFKSLLQKMIHQHLSSRTHGSEDS | 2.274 | 2369 |
| IL-21_5727 | N70G, A112P, T121E | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGRRQKHRLECP SCDSYEKKPPKEFLERFKSLLQKMIHQHLSSRTHGSEDS | 2.282 | 2370 |

TABLE 10-continued

IL-21 Combination Mutant Stabilized Variants

| Variant Name | Mutations | Amino Acid Sequence | Predicted Affinity | SEQ ID NO |
|---|---|---|---|---|
| IL-21_5928 | I45T, N70G, T110D, A112P | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKPPSDNPGRRQKHRLTCP SCDSYEKKPPKEFLERFKSLLQKMIHQHLSSRTHGSEDS | 2.294 | 2371 |
| IL-21_6417 | H35I, T110D | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSDNAGRRQKHRLTCP SCDSYEKKPPKEFLERFKSLLQKMIHQHLSSRTHGSEDS | 2.314 | 2372 |
| IL-21_6334 | H35F, I45T, P107V | MRSSPGNMERIVICLMVIFLGTLVHKSSSQGQDRFMIRMRQ LIDTVDQLKNYVNDLVPEFLPAPEDVETNCEWSAFSCFQKA QLKSANTGNNERIINVSIKKLKRKVPSTNAGRRQKHRLTCP SCDSYEKKPPKEFLERFKSLLQKMIHQHLSSRTHGSEDS | 2.329 | 2373 |
| IL-21_6394 | I45T, R114Q | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSTNAGQRQKHRLTCP SCDSYEKKPPKEFLERFKSLLQKMIHQHLSSRTHGSEDS | 2.333 | 2374 |
| IL-21_5781 | R114G, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNAGGRQKHTLTCP SCDSYEKKPPKEFLERFKSLLQKMIHQHLSSRTHGSEDS | 2.356 | 2375 |
| IL-21_6391 | I45T, R115G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSTNAGRGQKHRLTCP SCDSYEKKPPKEFLERFKSLLQKMIHQHLSSRTHGSEDS | 2.384 | 2376 |
| IL-21_5857 | I45T, T110D, A112P, R114Q | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSDNPGQRQKHRLTCP SCDSYEKKPPKEFLERFKSLLQKMIHQHLSSRTHGSEDS | 2.393 | 2377 |
| IL-21_6238 | H35I, I45T, N70G, A112P | MRSSPGNMERIVICLMVIFLGTLVHKSSSQGQDRIMIRMRQ LIDTVDQLKNYVNDLVPEFLPAPEDVETGCEWSAFSCFQKA QLKSANTGNNERIINVSIKKLKRKPPSTNPGRRQKHRLTCP SCDSYEKKPPKEFLERFKSLLQKMIHQHLSSRTHGSEDS | 2.403 | 2378 |
| IL-21_5841 | N70G, A112P | MRSSPGNMERIVICLMVIFLGTLVHKSSSQGQDRHMIRMRQ LIDIVDQLKNYVNDLVPEFLPAPEDVETGCEWSAFSCFQKA QLKSANTGNNERIINVSIKKLKRKPPSTNPGRRQKHRLTCP SCDSYEKKPPKEFLERFKSLLQKMIHQHLSSRTHGSEDS | 2.411 | 2379 |
| IL-21_6332 | H35F, I45T, A112P | MRSSPGNMERIVICLMVIFLGTLVHKSSSQGQDRFMIRMRQ LIDTVDQLKNYVNDLVPEFLPAPEDVETNCEWSAFSCFQKA QLKSANTGNNERIINVSIKKLKRKPPSTNPGRRQKHRLTCP SCDSYEKKPPKEFLERFKSLLQKMIHQHLSSRTHGSEDS | 2.463 | 2380 |
| IL-21_6217 | H35I, I45T, P107V, A112P | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKVPSTNPGRRQKHRLTCP SCDSYEKKPPKEFLERFKSLLQKMIHQHLSSRTHGSEDS | 2.467 | 2381 |
| IL-21_6400 | I45T, N70G | MRSSPGNMERIVICLMVIFLGTLVHKSSSQGQDRHMIRMRQ LIDTVDQLKNYVNDLVPEFLPAPEDVETGCEWSAFSCFQKA QLKSANTGNNERIINVSIKKLKRKPPSTNAGRRQKHRLTCP SCDSYEKKPPKEFLERFKSLLQKMIHQHLSSRTHGSEDS | 2.486 | 2382 |
| IL-21_6255 | I45T, T110D, A112P | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSDNPGRRQKHRLTCP SCDSYEKKPPKEFLERFKSLLQKMIHQHLSSRTHGSEDS | 2.543 | 2383 |
| IL-21_5804 | T110D, A112P | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNPGRRQKHRLTCP SCDSYEKKPPKEFLERFKSLLQKMIHQHLSSRTHGSEDS | 2.582 | 2384 |
| IL-21_6411 | H35F, I45T | MRSSPGNMERIVICLMVIFLGTLVHKSSSQGQDRFMIRMRQ LIDTVDQLKNYVNDLVPEFLPAPEDVETNCEWSAFSCFQKA QLKSANTGNNERIINVSIKKLKRKPPSTNAGRRQKHRLTCP SCDSYEKKPPKEFLERFKSLLQKMIHQHLSSRTHGSEDS | 2.582 | 2385 |

TABLE 10-continued

| IL-21 Combination Mutant Stabilized Variants | | | | |
|---|---|---|---|---|
| Variant Name | Mutations | Amino Acid Sequence | Predicted Affinity | SEQ ID NO |
| IL-21_6071 | H35F, I45T, P107V, A112P | MRSSPGNMERIVICLMVIFLGTLVHKSSSQGQDREMIRMRQ LIDTVDQLKNYVNDLVPEFLPAPEDVETNCEWSAFSCFQKA QLKSANTGNNERIINVSIKKLKRKVPSTNPGRRQKHRLTCP SCDSYEKKPPKEFLERFKSLLQKMIHQHLSSRTHGSEDS | 2.588 | 2386 |
| IL-21_6418 | H35I, P107V | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKVPSTNAGRRQKHRLTCP SCDSYEKKPPKEFLERFKSLLQKMIHQHLSSRTHGSEDS | 2.59 | 2387 |
| IL-21_5796 | A112P, R114Q | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGQRQKHRLTCP SCDSYEKKPPKEFLERFKSLLQKMIHQHLSSRTHGSEDS | 2.596 | 2388 |
| IL-21_5795 | A112P, R114G | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGGRQKHRLTCP SCDSYEKKPPKEFLERFKSLLQKMIHQHLSSRTHGSEDS | 2.616 | 2389 |
| IL-21_6260 | I45T, P107V, A112P | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKVPSTNPGRRQKHRLTCP SCDSYEKKPPKEFLERFKSLLQKMIHQHLSSRTHGSEDS | 2.673 | 2390 |
| IL-21_6416 | H35I, A112P | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKPPSTNPGRRQKHRLTCP SCDSYEKKPPKEFLERFKSLLQKMIHQHLSSRTHGSEDS | 2.695 | 2391 |
| IL-21_5797 | T110D, T121E | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSDNAGRRQKHRLECP SCDSYEKKPPKEFLERFKSLLQKMIHQHLSSRTHGSEDS | 2.703 | 2392 |
| IL-21_6355 | H35I, P107V, A112P | MRSSPGNMERIVICLMVIFLGTLVHKSSSQGQDRIMIRMRQ LIDIVDQLKNYVNDLVPEFLPAPEDVETNCEWSAFSCFQKA QLKSANTGNNERIINVSIKKLKRKVPSTNPGRRQKHRLTCP SCDSYEKKPPKEFLERFKSLLQKMIHQHLSSRTHGSEDS | 2.704 | 2393 |
| IL-21_6385 | H35I, I45T A112F | MRSSPGNMERIVICLMVIFLGTLVHKSSSQGQDRIMIRMRQ LIDTVDQLKNYVNDLVPEFLPAPEDVETNCEWSAFSCFQKA QLKSANTGNNERIINVSIKKLKRKPPSTNPGRRQKHRLTCP SCDSYEKKPPKEFLERFKSLLQKMIHQHLSSRTHGSEDS | 2.72 | 2394 |
| IL-21_5791 | A112P, R119T | MRSSPGNMERIVICLMVIFLGTLVHKSSSQGQDRHMIRMRQ LIDIVDQLKNYVNDLVPEFLPAPEDVETNCEWSAFSCFQKA QLKSANTGNNERIINVSIKKLKRKPPSTNPGRRQKHTLTCP SCDSYEKKPPKEFLERFKSLLQKMIHQHLSSRTHGSEDS | 2.72 | 2395 |
| IL-21_6393 | I45T, R114G | MRSSPGNMERIVICLMVIFLGTLVHKSSSQGQDRHMIRMRQ LIDTVDQLKNYVNDLVPEFLPAPEDVETNCEWSAFSCFQKA QLKSANTGNNERIINVSIKKLKRKPPSTNAGGRQKHRLTCP SCDSYEKKPPKEFLERFKSLLQKMIHQHLSSRTHGSEDS | 2.72 | 2396 |

A further set of 24 stabilized variants identified using AlphaSeq™ was produced as Fc fusion proteins in ExpiCHO™ cells. Titers and analytical SEC percent main peaks for this set of variants is shown in Table 11 below. As with the first iteration of stabilized variants, the second tested set showed a range of purities and titers, with the top variants demonstrating >200 μg/mL titer and >90% purity by analytical SEC.

TABLE 11

| Protein Expression Yields and Purity for Second Iteration Stabilized IL-21-Fc Fusion Proteins | | | |
|---|---|---|---|
| Variant | Titer (ug/mL) | Percent main peak | SEQ ID NO: |
| IL-21_5272 | 120.0 | 81.5 | 892 |
| IL-21_6018 | 241.8 | 93.0 | 894 |
| IL-21_5120 | 128.5 | 45.0 | 905 |
| IL-21_5707 | 174.7 | 86.6 | 933 |

TABLE 11-continued

| Protein Expression Yields and Purity for Second Iteration Stabilized IL-21-Fc Fusion Proteins | | | |
|---|---|---|---|
| Variant | Titer (ug/mL) | Percent main peak | SEQ ID NO: |
| IL-21_5997 | 123.5 | 78.9 | 930 |
| IL-21_5702 | 178.8 | 73.8 | 923 |
| IL-21_6318 | 217.0 | 93.4 | 950 |
| IL-21_5706 | 239.7 | 56.8 | 925 |
| IL-21_5999 | 239.1 | 82.8 | 958 |
| IL-21_5474 | 133.9 | 97.8 | 964 |
| IL-21_5834 | 218.3 | 65.1 | 996 |
| IL-21_6312 | 217.5 | 82.7 | 1025 |
| IL-21_5765 | 298.2 | 93.3 | 1192 |
| IL-21_5818 | 117.3 | 59.4 | 1201 |
| IL-21_5662 | 159.0 | 43.6 | 1218 |
| IL-21_6365 | 123.2 | 36.2 | 1223 |
| IL-21_5828 | 95.9 | 38.9 | 1253 |
| IL-21_5832 | 103.3 | 27.6 | 1464 |
| IL-21_5816 | 106.5 | 61.2 | 1490 |
| IL-21_5830 | 89.9 | 29.6 | 1501 |
| IL-21_6409 | 92.1 | 68.3 | 1675 |
| IL-21_5826 | 103.7 | 45.9 | 1744 |
| IL-21_5845 | 118.6 | 84.2 | 1698 |
| IL-21_6420 | 107.5 | 28.7 | 1904 |

Example 5: Identification of Stabilized and Detuned IL-21 Variants Using AlphaSeq™

To identify IL-21 variants with both stabilizing and detuning properties, a series of AlphaSeq™ assays were performed in which an SSM library was constructed for each of several stabilized variants identified in the experiments described in EXAMPLE 4. In the first assay, IL-21_0910, IL-21_3610, and IL-21_4177 were used as parental sequences, and a full SSM library was constructed for each parental sequence. In the second assay, IL-21_5474, IL-21_5707, IL-21_5845, IL-21_6018, and IL-21_6318 were selected as parental sequences, and a reduced SSM covering only positions Q32 to R115 in IL-21 was constructed for each parental sequence. A total of 14191 IL-21 variants were designed to be tested across the two assays for binding to human IL-21R. SSM library construction and AlphaSeq™ assays were performed as described in EXAMPLE 2, using unbuffered media. FACS-based expression values were also measured for each variant as described in EXAMPLE 2, with the modification that staining was performed using an antibody recognizing an N-terminal c-myc tag instead of a C-terminal HA tag. The distribution of replicate expression measurements for each of the parental IL-21 sequences is shown in FIG. 14. The distribution of expression values for each SSM library is shown in FIG. 15.

A set of two criteria was used to define detuned variants across the eight mutant libraries. First, as described above in EXAMPLE 2, detuned IL-21 variants were required to have expression values similar to or higher than parental IL-21, to avoid falsely identifying variants with decreased expression or stability as detuned. The expression value cutoff was defined relative to each parental IL-21 (e.g., IL-21_0910, IL-21_3610, and IL-21_4177) as 1 standard deviation less than the average of expression measurements of the parental IL-21. Second, the affinity to human IL-21R had to be at least a half-log reduced relative to the parental IL-21 sequence. The expression and affinity cutoffs for each of the variant libraries is shown in Table 12 below. The AlphaSeq™ replicate affinity distributions for each parental IL-21 sequence, filtered for those meeting the expression cutoff defined above, binding to human IL-21R are shown in FIG. 16. The affinity distributions for each SSM library, filtered for variants meeting the expression cutoff defined above, binding to human IL-21R are shown in FIG. 17.

From the eight mutant libraries tested, a total of 721 detuned stabilized variants were identified. These variants are listed in Table 13 below. The number of times each individual substitution was identified as detuning across the eight stabilized backgrounds are described below. Substitutions that confer detuning in multiple stabilized backgrounds can be considered general detuning substitutions, in contrast to those only identified in one stabilized background, which are more likely to be context-dependent detuning substitutions.

Substitutions Identified as Detuning in One Stabilized Background:

A112K, A75V, A75Y, A82H, A82I, A82K, A82M, A82T, A82V, A82Y, A87P, D110N, D110R, D110S, D3H, D3P, D33R, D33T, D33V, D33W, D44R, D47F, D47G, D47K, D47R, D55K, D55M, D55R, D55Y, D66K, D81A, D81F, D81I, D81L, D81M, D81Q, D81S, D81W, E59V, E59Y, E65R, E68G, E68R, E72R, E72T, E72W, E93F, E93I, E93K, E93P, E93V, E93Y, E98F, E98G, E98M, E98N, E98P, E98S, E98T, E98V, F76I, F76L, F76M, F76R, F76S, F76V, F79A, F79I, F79L, F79V, G113H, G70M, G70P, G70R, G70W, G90K, G90Y, H118K, I100A, I100E, I100Q, I100Y, I37A, I37Q, I43F, I43R, 143Y, I45F, I45N, I45Y, I95G, I96F, I96G, I96K, I96M, I96N, I96R, K101D, K101E, K102D, K102E, K102G, K102L, K102P, K102T, K104P, K106D, K106G, K106H, K106S, K85P, L103D, L103H, L103I, L103N, L103Q, L103T, L103W, L120S, L144M, L42R, L49F, L56D, L56E, L56F, L56T, L56V, L61K, L84F, L84P, L84T, M36P, M39A, M39P, N111R, N92G, N92P, N92Y, N97H, N97R, N97W, P107Y, P108E, P108H, P108L, P108M, P108Q, P108S, P112R, P58K, P58M, P62L, Q32I, Q41D, Q41E, Q80F, Q80H, Q80I, Q80L, Q80M, Q80S, Q80V, Q83H, Q83K, Q83V, R34A, R34G, R34H, R34I, R34P, R34T, R34Y, R38F, S74K, S74R, S77K, S77R, S77W, S86L, S86M, S86R, S99G, T110H, T45A, T89F, V107A, V107H, V107K, V107R, V53M, V53T, V67G, V67K, V67L, V98F, W73K, Y52G, Y52H, Y52K, Y52N, Y52Q, Y52R, Y52S, and Y52T.

Substitutions Identified as Detuning in Two Stabilized Backgrounds:

A112R, A82L, A82W, D110H, D44G, D44I, D44K, D44N, D44Q, D44V, D81Y, E93T, E98A, E98H, E98K, E98R, E98Y, G113R, G90I, G90Q, I100D, I100F, I100G, 1100H, I100R, I37F, I37S, I37T, I45G, I45R, I95K, I95R, I96D, I96H, I96P, I96Q, K102I, L103A, L103E, L103F, L103V, L103Y, L42K, L56S, M36R, M39G, N111K, N88R, N92W, N97K, N97P, P107G, P107H, P107K, P108A, P108G, P108N, P108R, Q41P, Q48R, Q80E, Q80G, Q80K, Q80N, Q80W, Q80Y, R105P, R34E, R34W, and S109K.

Substitutions Identified as Detuning in Three Stabilized Backgrounds:

D44A, D44H, D44L, D44M, D44P, D44W, D81H, D81K, E93S, F76T, I100S, I37K, I37P, I45A, I45K, I45S, I96A, I96E, I96S, I96Y, K102V, L103S, P107R, P108K, P108W, P108Y, Q41K, Q41R, Q41W, Q48K, Q80A, Q80R, Q83F, Q83L, Q83W, R105G, R38G, S99K, and S99P.

Substitutions Identified as Detuning in Four Stabilized Backgrounds:

D44S, D44T, D81R, E93R, F76K, I37D, I37E, I45Q, I96T, Q80D, R105A, R105E, R105F, R105T, R38E, R38T, S99R, and V98K.

Substitutions Identified as Detuning in Five Stabilized Backgrounds:

D44F, 137G, 137H, I37N, I37R, R105D, R105H, R105K, R105S, R105V, R34D, R38A, R38P, R38Q, R38S, and R38V.

Substitutions Identified as Detuning in Six Stabilized Backgrounds:

D44Y, I37W, I45W, R105I, R105M, R105N, R105Q, R38D, R38I, R38K, and R38M.

Substitutions Identified as Detuning in Seven Stabilized Backgrounds:

R105L, R105W, R105Y, R38L, R38N, and R38W.

TABLE 12

Cutoffs for defining detuned, stabilized variants from AlphaSeq ™

| Parental sequence | Expression cutoff | Affinity cutoff (nM) | Affinity cutoff ($log_{10}$ nM) | SEQ ID NO |
|---|---|---|---|---|
| IL-21_0910 | 2.12 | 30.7 | 1.49 | 465 |
| IL-21_3610 | 2.06 | 40.3 | 1.61 | 462 |
| IL-21_4177 | 1.94 | 111.6 | 2.05 | 463 |
| IL-21_5474 | 1.91 | 16.2 | 1.21 | 964 |
| IL-21_5707 | 1.95 | 23.8 | 1.38 | 933 |
| IL-21_5845 | 1.94 | 135.8 | 2.13 | 1698 |
| IL-21_6018 | 1.94 | 13.6 | 1.13 | 894 |
| IL-21_6318 | 1.99 | 22.0 | 1.34 | 950 |

TABLE 13

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 14667 | IL-21_ 6018 | H35F, D44Y, K81D, V98E, T110D | MRSSPGNMERIVICLMVIFLGTLVH<br>KSSSQGQDRFMIRMRQLIYIVDQLK<br>NYVNDLVPEFLPAPEDVETNCEWSA<br>FSCFQDAQLKSANTGNNERIINESI<br>KKLKRKPPSDNAGRRQKHRLTCPSC<br>DSYEKKPPKEFLERFKSLLQKMIHQ<br>HLSSRTHGSEDS | 1.141865875 | 2397 |
| IL-21_ 15601 | IL-21_ 6018 | H35F, K81D, 196T, V98E, T110D | MRSSPGNMERIVICLMVIFLGTLVH<br>KSSSQGQDRFMIRMRQLIDIVDQLK<br>NYVNDLVPEFLPAPEDVETNCEWSA<br>FSCFQDAQLKSANTGNNERITNESI<br>KKLKRKPPSDNAGRRQKHRLTCPSC<br>DSYEKKPPKEFLERFKSLLQKMIHQ<br>HLSSRTHGSEDS | 1.142647921 | 2398 |
| IL-21_ 15575 | IL-21_ 6018 | H35F, K81D, 195K, V98E, T110D | MRSSPGNMERIVICLMVIFLGTLVH<br>KSSSQGQDRFMIRMRQLIDIVDQLK<br>NYVNDLVPEFLPAPEDVETNCEWSA<br>FSCFQDAQLKSANTGNNERKINESI<br>KKLKRKPPSDNAGRRQKHRLTCPSC<br>DSYEKKPPKEFLERFKSLLQKMIHQ<br>HLSSRTHGSEDS | 1.146424431 | 2399 |
| IL-21_ 15312 | IL-21_ 6018 | H35F, Q80R, K81D, V98E, T110D | MRSSPGNMERIVICLMVIFLGTLVH<br>KSSSQGQDRFMIRMRQLIDIVDQLK<br>NYVNDLVPEFLPAPEDVETNCEWSA<br>FSCFRDAQLKSANTGNNERIINESI<br>KKLKRKPPSDNAGRRQKHRLTCPSC<br>DSYEKKPPKEFLERFKSLLQKMIHQ<br>HLSSRTHGSEDS | 1.146491509 | 2400 |
| IL-21_ 14666 | IL-21_ 6018 | H35F, D44W, K81D, V98E, T110D | MRSSPGNMERIVICLMVIFLGTLVH<br>KSSSQGQDRFMIRMRQLIWIVDQLK<br>NYVNDLVPEFLPAPEDVETNCEWSA<br>FSCFQDAQLKSANTGNNERIINESI<br>KKLKRKPPSDNAGRRQKHRLTCPSC<br>DSYEKKPPKEFLERFKSLLQKMIHQ<br>HLSSRTHGSEDS | 1.149689616 | 2401 |
| IL-21_ 15385 | IL-21_ 6018 | H35F, K81D, L84T, V98E, T110D | MRSSPGNMERIVICLMVIFLGTLVH<br>KSSSQGQDRFMIRMRQLIDIVDQLK<br>NYVNDLVPEFLPAPEDVETNCEWSA<br>FSCFQDAQTKSANTGNNERIINESI<br>KKLKRKPPSDNAGRRQKHRLTCPSC<br>DSYEKKPPKEFLERFKSLLQKMIHQ<br>HLSSRTHGSEDS | 1.15175483 | 2402 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 14677 | IL-21_ 6018 | H35F, I45N, K81D, V98E, T110D | MRSSPGNMERIVICLMVIFLGTLVH KSSSQGQDRFMIRMRQLIDNVDQLK NYVNDLVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 1.158552215 | 2403 |
| IL-21_ 14338 | IL-21_ 6018 | H35F, K81D, V98E, T110H | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKRKPPSHNAGRRQKHRLTCPSC DSYEKKPPKEFLERFKSLLQKMIHQ HLSSRTHGSEDS | 1.181751989 | 2404 |
| IL-21_ 14668 | IL-21_ 6018 | H35F, I45A, K81D, V98E, T110D | MRSSPGNMERIVICLMVIFLGTLVH KSSSQGQDRFMIRMRQLIDAVDQLK NYVNDLVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 1.183022098 | 2405 |
| IL-21_ 15282 | IL-21_ 6018 | H35F, F79A, K81D, V98E, T110D | MRSSPGNMERIVICLMVIFLGTLVH KSSSQGQDRFMIRMRQLIDIVDQLK NYVNDLVPEFLPAPEDVETNCEWSA FSCAQDAQLKSANTGNNERIINESI KKLKRKPPSDNAGRRQKHRLTCPSC DSYEKKPPKEFLERFKSLLQKMIHQ HLSSRTHGSEDS | 1.190623133 | 2406 |
| IL-21_ 20126 | IL-21_ 5474 | N70G, K81D, N97K, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIIKVSI KKLKRKPPSTNAGQDQKHRLTCPSC DSYEKKPPKEFLERFKSLLQKMIHQ HLSSRTHGSEDS | 1.214196921 | 2407 |
| IL-21_ 14734 | IL-21_ 6018 | H35F, Q48R, K81D, V98E, T110D | MRSSPGNMERIVICLMVIFLGTLVH KSSSQGQDRFMIRMRQLIDIVDRLK NYVNDLVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 1.216458896 | 2408 |
| IL-21_ 15809 | IL-21_ 6018 | H35F, K81D, V98E, P108K, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKRKPKSDNAGRRQKHRLTCPSC DSYEKKPPKEFLERFKSLLQKMIHQ HLSSRTHGSEDS | 1.221774047 | 2409 |
| IL-21_ 14346 | IL-21_ 6018 | H35F, K81D, V98E, T110R | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKRKPPSRNAGRRQKHRLTCPSC DSYEKKPPKEFLERFKSLLQKMIHQ HLSSRTHGSEDS | 1.223326102 | 2410 |
| IL-21_ 15615 | IL-21_ 6018 | H35F, K81D, N97P, V98E, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIIPESI KKLKRKPPSDNAGRRQKHRLTCPSC DSYEKKPPKEFLERFKSLLQKMIHQ HLSSRTHGSEDS | 1.223946407 | 2411 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 14685 | IL-21_ 6018 | H35F, I45Y, K81D, V98E, T110D | MRSSPGNMERIVICLMVIFLGTLVH KSSSQGQDRFMIRMRQLIDYVDQLK NYVNDLVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 1.232401147 | 2412 |
| IL-21_ 19053 | IL-21_ 5474 | I37T, N70G, K81D, R114Q, R115D | MRSSPGNMERIVICLMVIFLGTLVH KSSSQGQDRHMTRMRQLIDIVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 1.235249266 | 2413 |
| IL-21_ 19316 | IL-21_ 5474 | Y52K, N70G, K81D, R114Q, R115D | MRSSPGNMERIVICLMVIFLGTLVH KSSSQGQDRHMIRMRQLIDIVDQLK NKVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 1.238349424 | 2414 |
| IL-21_ 15241 | IL-21_ 6018 | H35F, F76T, K81D, V98E, T110D | MRSSPGNMERIVICLMVIFLGTLVH KSSSQGQDRFMIRMRQLIDIVDQLK NYVNDLVPEFLPAPEDVETNCEWSA TSCFQDAQLKSANTGNNERIINESI KKLKRKPPSDNAGRRQKHRLTCPSC DSYEKKPPKEFLERFKSLLQKMIHQ HLSSRTHGSEDS | 1.238444874 | 2415 |
| IL-21_ 14653 | IL-21_ 6018 | H35F, D44G, K81D, V98E, T110D | MRSSPGNMERIVICLMVIFLGTLVH KSSSQGQDRFMIRMRQLIGIVDQLK NYVNDLVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 1.238712327 | 2416 |
| IL-21_ 19052 | IL-21_ 5474 | I37S, N70G, K81D, R114Q, R115D | MRSSPGNMERIVICLMVIFLGTLVH KSSSQGQDRHMSRMRQLIDIVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 1.247121451 | 2417 |
| IL-21_ 15071 | IL-21_ 6018 | H35F, V67K, K81D, V98E, T110D | MRSSPGNMERIVICLMVIFLGTLVH KSSSQGQDRFMIRMRQLIDIVDQLK NYVNDLVPEFLPAPEDKETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 1.24944817 | 2418 |
| IL-21_ 20282 | IL-21_ 5474 | N70G, K81D, K106D, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKRDPPSTNAGQDQKHRLTCPSC DSYEKKPPKEFLERFKSLLQKMIHQ HLSSRTHGSEDS | 1.255119474 | 2419 |
| IL-21_ 15301 | IL-21_ 6018 | H35F, Q80D, K81D, V98E, T110D | MRSSPGNMERIVICLMVIFLGTLVH KSSSQGQDRFMIRMRQLIDIVDQLK NYVNDLVPEFLPAPEDVETNCEWSA FSCFDDAQLKSANTGNNERIINESI KKLKRKPPSDNAGRRQKHRLTCPSC DSYEKKPPKEFLERFKSLLQKMIHQ HLSSRTHGSEDS | 1.260803913 | 2420 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 19738 | IL-21_ 5474 | N70G, A75V, K81D, R114Q, R115D | MRSSPGNMERIVICLMVIFLGTLVHKSSSQGQDRHMIRMRQLIDIVDQLKNYVNDLVPEFLPAPEDVETGCEWSVFSCFQDAQLKSANTGNNERIINVSIKKLKRKPPSTNAGQDQKHRLTCPSCDSYEKKPPKEFLERFKSLLQKMIHQHLSSRTHGSEDS | 1.265351538 | 2421 |
| IL-21_ 19836 | IL-21_ 5474 | N70G, K81H, R114Q, R115D | MRSSPGNMERIVICLMVIFLGTLVHKSSSQGQDRHMIRMRQLIDIVDQLKNYVNDLVPEFLPAPEDVETGCEWSAFSCFQHAQLKSANTGNNERIINVSIKKLKRKPPSTNAGQDQKHRLTCPSCDSYEKKPPKEFLERFKSLLQKMIHQHLSSRTHGSEDS | 1.266310706 | 2422 |
| IL-21_ 20057 | IL-21_ 5474 | N70G, K81D, E93P, R114Q, R115D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNPRIINVSIKKLKRKPPSTNAGQDQKHRLTCPSCDSYEKKPPKEFLERFKSLLQKMIHQHLSSRTHGSEDS | 1.267316873 | 2423 |
| IL-21_ 15653 | IL-21_ 6018 | H35F, K81D, V98E, S99R, T110D | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINERIKKLKRKPPSDNAGRRQKHRLTCPSCDSYEKKPPKEFLERFKSLLQKMIHQHLSSRTHGSEDS | 1.275292788 | 2424 |
| IL-21_ 19857 | IL-21_ 5474 | N70G, K81D, A82M, R114Q, R115D | MRSSPGNMERIVICLMVIFLGTLVHKSSSQGQDRHMIRMRQLIDIVDQLKNYVNDLVPEFLPAPEDVETGCEWSAFSCFQDMQLKSANTGNNERIINVSIKKLKRKPPSTNAGQDQKHRLTCPSCDSYEKKPPKEFLERFKSLLQKMIHQHLSSRTHGSEDS | 1.283712661 | 2425 |
| IL-21_ 14474 | IL-21_ 6018 | R34E, H35F, K81D, V98E, T110D | MRSSPGNMERIVICLMVIFLGTLVHKSSSQGQDEFMIRMRQLIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS | 1.284462806 | 2426 |
| IL-21_ 19313 | IL-21_ 5474 | Y52G, N70G, K81D, R114Q, R115D | MRSSPGNMERIVICLMVIFLGTLVHKSSSQGQDRHMIRMRQLIDIVDQLKNGVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS | 1.284556077 | 2427 |
| IL-21_ 15329 | IL-21_ 6018 | H35F, K81R, V98E, T110D | MRSSPGNMERIVICLMVIFLGTLVHKSSSQGQDRFMIRMRQLIDIVDQLKNYVNDLVPEFLPAPEDVETNCEWSAFSCFQRAQLKSANTGNNERIINESIKKLKRKPPSDNAGRRQKHRLTCPSCDSYEKKPPKEFLERFKSLLQKMIHQHLSSRTHGSEDS | 1.285114941 | 2428 |
| IL-21_ 19165 | IL-21_ 5474 | D44A, N70G, K81D, R114Q, R115D | MRSSPGNMERIVICLMVIFLGTLVHKSSSQGQDRHMIRMRQLIAIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS | 1.286819917 | 2429 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 14716 | IL-21_ 6018 | H35F, D47R, K81D, V98E, T110D | MRSSPGNMERIVICLMVIFLGTLVH KSSSQGQDRFMIRMRQLIDIVRQLK NYVNDLVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 1.287555273 | 2430 |
| IL-21_ 15625 | IL-21_ 6018 | H35F, K81D, V98F, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 1.289622695 | 2431 |
| IL-21_ 19847 | IL-21_ 5474 | N70G, K81W, R114Q, R115D | MRSSPGNMERIVICLMVIFLGTLVH KSSSQGQDRHMIRMRQLIDIVDQLK NYVNDLVPEFLPAPEDVETGCEWSA FSCFQWAQLKSANTGNNERIINVSI KKLKRKPPSTNAGQDQKHRLTCPSC DSYEKKPPKEFLERFKSLLQKMIHQ HLSSRTHGSEDS | 1.293005848 | 2432 |
| IL-21_ 20010 | IL-21_ 5474 | N70G, K81D, G90Y, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTYNNERIINVSI KKLKRKPPSTNAGQDQKHRLTCPSC DSYEKKPPKEFLERFKSLLQKMIHQ HLSSRTHGSEDS | 1.303920884 | 2433 |
| IL-21_ 15322 | IL-21_ 6018 | H35F, K81H, V98E, T110D | MRSSPGNMERIVICLMVIFLGTLVH KSSSQGQDRFMIRMRQLIDIVDQLK NYVNDLVPEFLPAPEDVETNCEWSA FSCFQHAQLKSANTGNNERIINESI KKLKRKPPSDNAGRRQKHRLTCPSC DSYEKKPPKEFLERFKSLLQKMIHQ HLSSRTHGSEDS | 1.304372763 | 2434 |
| IL-21_ 19048 | IL-21_ 5474 | I37N, N70G, K81D, R114Q, R115D | MRSSPGNMERIVICLMVIFLGTLVH KSSSQGQDRHMNRMRQLIDIVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 1.315935377 | 2435 |
| IL-21_ 14558 | IL-21_ 6018 | H35F, R38W, K81D, V98E, T110D | MRSSPGNMERIVICLMVIFLGTLVH KSSSQGQDRFMIWMRQLIDIVDQLK NYVNDLVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 1.319433734 | 2436 |
| IL-21_ 19848 | IL-21_ 5474 | N70G, K81Y, R114Q, R115D | MRSSPGNMERIVICLMVIFLGTLVH KSSSQGQDRHMIRMRQLIDIVDQLK NYVNDLVPEFLPAPEDVETGCEWSA FSCFQYAQLKSANTGNNERIINVSI KKLKRKPPSTNAGQDQKHRLTCPSC DSYEKKPPKEFLERFKSLLQKMIHQ HLSSRTHGSEDS | 1.332413877 | 2437 |
| IL-21_ 15341 | IL-21_ 6018 | H35F, K81D, A82K, V98E, T110D | MRSSPGNMERIVICLMVIFLGTLVH KSSSQGQDRFMIRMRQLIDIVDQLK NYVNDLVPEFLPAPEDVETNCEWSA FSCFQDKQLKSANTGNNERIINESI KKLKRKPPSDNAGRRQKHRLTCPSC DSYEKKPPKEFLERFKSLLQKMIHQ HLSSRTHGSEDS | 1.333623295 | 2438 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 19843 | IL-21_ 5474 | N70G, K81R, R114Q, R115D | MRSSPGNMERIVICLMVIFLGTLVH KSSSQGQDRHMIRMRQLIDIVDQLK NYVNDLVPEFLPAPEDVETGCEWSA FSCFQRAQLKSANTGNNERIINVSI KKLKRKPPSTNAGQDQKHRLTCPSC DSYEKKPPKEFLERFKSLLQKMIHQ HLSSRTHGSEDS | 1.33412654 | 2439 |
| IL-21_ 19383 | IL-21_ 5474 | L56E, N70G, K81D, R114Q, R115D | MRSSPGNMERIVICLMVIFLGTLVH KSSSQGQDRHMIRMRQLIDIVDQLK NYVNDEVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 1.338807053 | 2440 |
| IL-21_ 19196 | IL-21_ 5474 | I45S, N70G, K81D, R114Q, R115D | MRSSPGNMERIVICLMVIFLGTLVH KSSSQGQDRHMIRMRQLIDSVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 1.347240428 | 2441 |
| IL-21_ 14879 | IL-21_ 6018 | H35F, L56S, K81D, V98E, T110D | MRSSPGNMERIVICLMVIFLGTLVH KSSSQGQDRFMIRMRQLIDIVDQLK NYVNDSVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 1.349383072 | 2442 |
| IL-21_ 20173 | IL-21_ 5474 | N70G, K81D, I100A, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSA KKLKRKPPSTNAGQDQKHRLTCPSC DSYEKKPPKEFLERFKSLLQKMIHQ HLSSRTHGSEDS | 1.351202973 | 2443 |
| IL-21_ 20215 | IL-21_ 5474 | N70G, K81D, K102I, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KILKRKPPSTNAGQDQKHRLTCPSC DSYEKKPPKEFLERFKSLLQKMIHQ HLSSRTHGSEDS | 1.353932794 | 2444 |
| IL-21_ 15351 | IL-21_ 6018 | H35F, K81D, A82W, V98E, T110D | MRSSPGNMERIVICLMVIFLGTLVH KSSSQGQDRFMIRMRQLIDIVDQLK NYVNDLVPEFLPAPEDVETNCEWSA FSCFQDWQLKSANTGNNERIINESI KKLKRKPPSDNAGRRQKHRLTCPSC DSYEKKPPKEFLERFKSLLQKMIHQ HLSSRTHGSEDS | 1.360107483 | 2445 |
| IL-21_ 13409 | IL-21_ 6318 | H35F, P58M, K81D, V98E | MRSSPGNMERIVICLMVIFLGTLVH KSSSQGQDRFMIRMRQLIDIVDQLK NYVNDLVMEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 1.368302268 | 2446 |
| IL-21_ 13039 | IL-21_ 6318 | H35F, I37W, K81D, V98E | MRSSPGNMERIVICLMVIFLGTLVH KSSSQGQDRFMWRMRQLIDIVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 1.369335913 | 2447 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 14380 | IL-21_ 6318 | H35F, K81D, V98E, A112R | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKRKPPSTNRGRRQKHRLTCPSCDSYEKKPPKEFLERFKSLLQKMIHQHLSSRTHGSEDS | 1.374591907 | 2448 |
| IL-21_ 19225 | IL-21_ 5474 | D47K, N70G, K81D, R114Q, R115D | MRSSPGNMERIVICLMVIFLGTLVHKSSSQGQDRHMIRMRQLIDIVKQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS | 1.376791122 | 2449 |
| IL-21_ 13407 | IL-21_ 6318 | H35F, P58K, K81D, V98E | MRSSPGNMERIVICLMVIFLGTLVHKSSSQGQDRFMIRMRQLIDIVDQLKNYVNDLVKEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 1.378488015 | 2450 |
| IL-21_ 18633 | IL-21_ 5707 | K81D, V98A, P107V | MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINASIKKLKRKVPSTNAGRRQKHRLTCPSCDSYEKKPPKEFLERFKSLLQKMIHQHLSSRTHGSEDS | 1.381511818 | 2451 |
| IL-21_ 17676 | IL-21_ 5707 | D44T, K81D, V98E, P107V | MRSSPGNMERIVICLMVIFLGTLVHKSSSQGQDRHMIRMRQLITIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS | 1.382273341 | 2452 |
| IL-21_ 20144 | IL-21_ 5474 | N70G, K81D, V98K, R114Q, R115D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINKSIKKLKRKPPSTNAGQDQKHRLTCPSCDSYEKKPPKEFLERFKSLLQKMIHQHLSSRTHGSEDS | 1.385790216 | 2453 |
| IL-21_ 14323 | IL-21_ 6318 | H35F, K81D, V98E, S109K | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKRKPPKTNAGRRQKHRLTCPSCDSYEKKPPKEFLERFKSLLQKMIHQHLSSRTHGSEDS | 1.38600227 | 2454 |
| IL-21_ 20115 | IL-21_ 5474 | N70G, K81D, 196T, R114Q, R115D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERITNVSIKKLKRKPPSTNAGQDQKHRLTCPSCDSYEKKPPKEFLERFKSLLQKMIHQHLSSRTHGSEDS | 1.386218421 | 2455 |
| IL-21_ 19055 | IL-21_ 5474 | I37W, N70G, K81D, R114Q, R115D | MRSSPGNMERIVICLMVIFLGTLVHKSSSQGQDRHMWRMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS | 1.397477421 | 2456 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 12941 | IL-21_ 6318 | Q32I, H35F, K81D, V98E | MRSSPGNMERIVICLMVIFLGTLVHKSSSQGIDRFMIRMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 1.403740249 | 2457 |
| IL-21_ 18371 | IL-21_ 5707 | K81D, Q83L, V98E, P107V | MRSSPGNMERIVICLMVIFLGTLVHKSSSQGQDRHMIRMRQLIDIVDQLKNYVNDLVPEFLPAPEDVETNCEWSAFSCFQDALLKSANTGNNERIINESIKKLKRKVPSTNAGRRQKHRLTCPSCDSYEKKPPKEFLERFKSLLQKMIHQHLSSRTHGSEDS | 1.404420084 | 2458 |
| IL-21_ 18597 | IL-21_ 5707 | K81D, 196A, V98E, P107V | MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIANESIKKLKRKVPSTNAGRRQKHRLTCPSCDSYEKKPPKEFLERFKSLLQKMIHQHLSSRTHGSEDS | 1.405097312 | 2459 |
| IL-21_ 19221 | IL-21_ 5474 | D47F, N70G, K81D, R114Q, R115D | MRSSPGNMERIVICLMVIFLGTLVHKSSSQGQDRHMIRMRQLIDIVFQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS | 1.409036741 | 2460 |
| IL-21_ 20311 | IL-21_ 5474 | N70G, K81D, P107R, R114Q, R115D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKRPSTNAGQDQKHRLTCPSCDSYEKKPPKEFLERFKSLLQKMIHQHLSSRTHGSEDS | 1.409171876 | 2461 |
| IL-21_ 18627 | IL-21_ 5707 | K81D, N97R, V98E, P107V | MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIIRESIKKLKRKVPSTNAGRRQKHRLTCPSCDSYEKKPPKEFLERFKSLLQKMIHQHLSSRTHGSEDS | 1.410019216 | 2462 |
| IL-21_ 18079 | IL-21_ 5707 | V67G, K81D, V98E, P107V | MRSSPGNMERIVICLMVIFLGTLVHKSSSQGQDRHMIRMRQLIDIVDQLKNYVNDLVPEFLPAPEDGETNCEWSAFSCFQDAQLKSANTGNNERIINESIKKLKRKVPSTNAGRRQKHRLTCPSCDSYEKKPPKEFLERFKSLLQKMIHQHLSSRTHGSEDS | 1.410964946 | 2463 |
| IL-21_ 13057 | IL-21_ 6318 | H35F, R38W, K81D, V98E | MRSSPGNMERIVICLMVIFLGTLVHKSSSQGQDRFMIWMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 1.414031637 | 2464 |
| IL-21_ 18719 | IL-21_ 5707 | K81D, V98E, K102V, P107V | MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKVLKRKVPSTNAGRRQKHRLTCPSCDSYEKKPPKEFLERFKSLLQKMIHQHLSSRTHGSEDS | 1.415862315 | 2465 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 17677 | IL-21_ 5707 | D44V, K81D, V98E, P107V | MRSSPGNMERIVICLMVIFLGTLVHKSSSQGQDRHMIRMRQLIVIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS | 1.417572884 | 2466 |
| IL-21_ 18876 | IL-21_ 5707 | K81D, V98E, P107V, N111R | MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKVPSTRAGRRQKHRLTCPSCDSYEKKPPKEFLERFKSLLQKMIHQHLSSRTHGSEDS | 1.420755309 | 2467 |
| IL-21_ 19478 | IL-21_ 5474 | L61K, N70G, K81D, R114Q, R115D | MRSSPGNMERIVICLMVIFLGTLVHKSSSQGQDRHMIRMRQLIDIVDQLKNYVNDLVPEFKPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS | 1.423181753 | 2468 |
| IL-21_ 19818 | IL-21_ 5474 | N70G, Q80G, K81D, R114Q, R115D | MRSSPGNMERIVICLMVIFLGTLVHKSSSQGQDRHMIRMRQLIDIVDQLKNYVNDLVPEFLPAPEDVETGCEWSAFSCFGDAQLKSANTGNNERIINVSIKKLKRKPPSTNAGQDQKHRLTCPSCDSYEKKPPKEFLERFKSLLQKMIHQHLSSRTHGSEDS | 1.438081251 | 2469 |
| IL-21_ 13028 | IL-21_ 6318 | H35F, 137H, K81D, V98E | MRSSPGNMERIVICLMVIFLGTLVHKSSSQGQDRFMHRMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 1.440410333 | 2470 |
| IL-21_ 13025 | IL-21_ 6318 | H35F, I37E, K81D, V98E | MRSSPGNMERIVICLMVIFLGTLVHKSSSQGQDREMERMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 1.445347673 | 2471 |
| IL-21_ 14672 | IL-21_ 6018 | H35F, I45G, K81D, V98E, T110D | MRSSPGNMERIVICLMVIFLGTLVHKSSSQGQDRFMIRMRQLIDGVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS | 1.446214488 | 2472 |
| IL-21_ 14120 | IL-21_ 6318 | H35F, K81D, V98A | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINASIKKLKRKPPSTNAGRRQKHRLTCPSCDSYEKKPPKEFLERFKSLLQKMIHQHLSSRTHGSEDS | 1.448314715 | 2473 |
| IL-21_ 19803 | IL-21_ 5474 | N70G, F79L, K81D, R114Q, R115D | MRSSPGNMERIVICLMVIFLGTLVHKSSSQGQDRHMIRMRQLIDIVDQLKNYVNDLVPEFLPAPEDVETGCEWSAFSCLQDAQLKSANTGNNERIINVSIKKLKRKPPSTNAGQDQKHRLTCPSCDSYEKKPPKEFLERFKSLLQKMIHQHLSSRTHGSEDS | 1.448984601 | 2474 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 18636 | IL-21_ 5707 | K81D, V98G, P107V | MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINGSIKKLKRKVPSTNAGRRQKHRLTCPSCDSYEKKPPKEFLERFKSLLQKMIHQHLSSRTHGSEDS | 1.450257264 | 2475 |
| IL-21_ 14136 | IL-21_ 6318 | H35F, K81D, V98Y | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINYSIKKLKRKPPSTNAGRRQKHRLTCPSCDSYEKKPPKEFLERFKSLLQKMIHQHLSSRTHGSEDS | 1.452694091 | 2476 |
| IL-21_ 13154 | IL-21_ 6318 | H35F, D44I, K81D, V98E | MRSSPGNMERIVICLMVIFLGTLVHKSSSQGQDRFMIRMRQLIIIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 1.456376867 | 2477 |
| IL-21_ 17667 | IL-21_ 5707 | D44I, K81D, V98E, P107V | MRSSPGNMERIVICLMVIFLGTLVHKSSSQGQDRHMIRMRQLIIIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS | 1.463486288 | 2478 |
| IL-21_ 5726 | IL-21_ 5474 | N70G, R114Q, R115D | MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGQDQKHRLTCPSCDSYEKKPPKEFLERFKSLLQKMIHQHLSSRTHGSEDS | 1.466406698 | 2479 |
| IL-21_ 13798 | IL-21_ 6318 | H35F, Q80D, K81D, V98E | MRSSPGNMERIVICLMVIFLGTLVHKSSSQGQDRFMIRMRQLIDIVDQLKNYVNDLVPEFLPAPEDVETNCEWSAFSCFDDAQLKSANTGNNERIINESIKKLKRKPPSTNAGRRQKHRLTCPSCDSYEKKPPKEFLERFKSLLQKMIHQHLSSRTHGSEDS | 1.472491529 | 2480 |
| IL-21_ 20053 | IL-21_ 5474 | N70G, K81D, E93K, R114Q, R115D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNKRIINVSIKKLKRKPPSTNAGQDQKHRLTCPSCDSYEKKPPKEFLERFKSLLQKMIHQHLSSRTHGSEDS | 1.47279202 | 2481 |
| IL-21_ 19831 | IL-21_ 5474 | N70G, Q80Y, K81D, R114Q, R115D | MRSSPGNMERIVICLMVIFLGTLVHKSSSQGQDRHMIRMRQLIDIVDQLKNYVNDLVPEFLPAPEDVETGCEWSAFSCFYDAQLKSANTGNNERIINVSIKKLKRKPPSTNAGQDQKHRLTCPSCDSYEKKPPKEFLERFKSLLQKMIHQHLSSRTHGSEDS | 1.475944771 | 2482 |
| IL-21_ 19171 | IL-21_ 5474 | D44K, N70G, K81D, R114Q, R115D | MRSSPGNMERIVICLMVIFLGTLVHKSSSQGQDRHMIRMRQLIKIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS | 1.482147269 | 2483 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 17552 | IL-21_ 5707 | I37W, K81D, V98E, P107V | MRSSPGNMERIVICLMVIFLGTLVHKSSSQGQDRHMWRMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS | 1.484882695 | 2484 |
| IL-21_ 15651 | IL-21_ 6018 | H35F, K81D, V98E, S99P, T110D | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINEPIKKLKRKPPSDNAGRRQKHRLTCPSCDSYEKKPPKEFLERFKSLLQKMIHQHLSSRTHGSEDS | 1.487888672 | 2485 |
| IL-21_ 14205 | IL-21_ 6318 | H35F, K81D, V98E, K102T | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKTLKRKPPSTNAGRRQKHRLTCPSCDSYEKKPPKEFLERFKSLLQKMIHQHLSSRTHGSEDS | 1.48841929 | 2486 |
| IL-21_ 15240 | IL-21_ 6018 | H35F, F76S, K81D, V98E, T110D | MRSSPGNMERIVICLMVIFLGTLVHKSSSQGQDRFMIRMRQLIDIVDQLKNYVNDLVPEFLPAPEDVETNCEWSASSCFQDAQLKSANTGNNERIINESIKKLKRKPPSDNAGRRQKHRLTCPSCDSYEKKPPKEFLERFKSLLQKMIHQHLSSRTHGSEDS | 1.489715311 | 2487 |
| IL-21_ 17680 | IL-21_ 5707 | I45A, K81D, V98E, P107V | MRSSPGNMERIVICLMVIFLGTLVHKSSSQGQDRHMIRMRQLIDAVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS | 1.493380021 | 2488 |
| IL-21_ 14867 | IL-21_ 6018 | H35F, L56D, K81D, V98E, T110D | MRSSPGNMERIVICLMVIFLGTLVHKSSSQGQDRFMIRMRQLIDIVDQLKNYVNDDVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS | 1.493784765 | 2489 |
| IL-21_ 14552 | IL-21_ 6018 | H35F, R38N, K81D, V98E, T110D | MRSSPGNMERIVICLMVIFLGTLVHKSSSQGQDRFMINMRQLIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS | 1.494626816 | 2490 |
| IL-21_ 11826 | IL-21_ 0910 | I45T, K81D, E93S, V98E | MRSSPGNMERIVICLMVIFLGTLVHKSSSQGQDRHMIRMRQLIDTVDQLKNYVNDLVPEFLPAPEDVETNCEWSAFSCFQDAQLKSANTGNNSRIINESIKKLKRKPPSTNAGRRQKHRLTCPSCDSYEKKPPKEFLERFKSLLQKMIHQHLSSRTHGSEDS | 1.49494524 | 2491 |
| IL-21_ 18642 | IL-21_ 5707 | K81D, V98N, P107V | MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINNSIKKLKRKVPSTNAGRRQKHRLTCPSCDSYEKKPPKEFLERFKSLLQKMIHQHLSSRTHGSEDS | 1.496040626 | 2492 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 17537 | IL-21_ 5707 | I37D, K81D, V98E, P107V | MRSSPGNMERIVICLMVIFLGTLVHKSSSQGQDRHMDRMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS | 1.499191879 | 2493 |
| IL-21_ 14660 | IL-21_ 6018 | H35F, D44P, K81D, V98E, T110D | MRSSPGNMERIVICLMVIFLGTLVHKSSSQGQDRFMIRMRQLIPIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS | 1.500458197 | 2494 |
| IL-21_ 13151 | IL-21_ 6318 | H35F, D44F, K81D, V98E | MRSSPGNMERIVICLMVIFLGTLVHKSSSQGQDRFMIRMRQLIFIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 1.500534358 | 2495 |
| IL-21_ 12277 | IL-21_ 0910 | I45T, E68R, K81D, V98E | MRSSPGNMERIVICLMVIFLGTLVHKSSSQGQDRHMIRMRQLIDTVDQLKNYVNDLVPEFLPAPEDVRTNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 1.503749724 | 2496 |
| IL-21_ 13032 | IL-21_ 6318 | H35F, I37N, K81D, V98E | MRSSPGNMERIVICLMVIFLGTLVHKSSSQGQDRFMNRMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 1.509008208 | 2497 |
| IL-21_ 12892 | IL-21_ 0910 | R34I, I45T, K81D, V98E | MRSSPGNMERIVICLMVIFLGTLVHKSSSQGQDIHMIRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 1.510447886 | 2498 |
| IL-21_ 17675 | IL-21_ 5707 | D44S, K81D, V98E, P107V | MRSSPGNMERIVICLMVIFLGTLVHKSSSQGQDRHMIRMRQLISIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS | 1.513808121 | 2499 |
| IL-21_ 14197 | IL-21_ 6318 | H35F, K81D, V98E, K102I | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKILKRKPPSTNAGRRQKHRLTCPSCDSYEKKPPKEFLERFKSLLQKMIHQHLSSRTHGSEDS | 1.516229732 | 2500 |
| IL-21_ 19169 | IL-21_ 5474 | D44H, N70G, K81D, R114Q, R115D | MRSSPGNMERIVICLMVIFLGTLVHKSSSQGQDRHMIRMRQLIHIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS | 1.518333885 | 2501 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 12852 | IL-21_ 0910 | M36R, I45T, K81D, V98E | MRSSPGNMERIVICLMVIFLGTLVH KSSSQGQDRHRIRMRQLIDTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 1.518521226 | 2502 |
| IL-21_ 20224 | IL-21_ 5474 | N70G, K81D, K102V, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KVLKRKPPSTNAGQDQKHRLTCPSC DSYEKKPPKEFLERFKSLLQKMIHQ HLSSRTHGSEDS | 1.527290858 | 2503 |
| IL-21_ 19044 | IL-21_ 5474 | I37H, N70G, K81D, R114Q, R115D | MRSSPGNMERIVICLMVIFLGTLVH KSSSQGQDRHMHRMRQLIDIVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 1.527628673 | 2504 |
| IL-21_ 18871 | IL-21_ 5707 | K81D, V98E, P107V, N111K | MRSSPGNMERIVICLMVIFLGTLVH KSSSQGQDRHMIRMRQLIDIVDQLK NYVNDLVPEFLPAPEDVETNCEWSA FSCFQDAQLKSANTGNNERIINESI KKLKRKVPSTKAGRRQKHRLTCPSC DSYEKKPPKEFLERFKSLLQKMIHQ HLSSRTHGSEDS | 1.527718503 | 2505 |
| IL-21_ 12702 | IL-21_ 0910 | I45A, K81D, V98E | MRSSPGNMERIVICLMVIFLGTLVH KSSSQGQDRHMIRMRQLIDAVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 1.531957757 | 2506 |
| IL-21_ 11827 | IL-21_ 0910 | I45T, K81D, E93R, V98E | MRSSPGNMERIVICLMVIFLGTLVH KSSSQGQDRHMIRMRQLIDTVDQLK NYVNDLVPEFLPAPEDVETNCEWSA FSCFQDAQLKSANTGNNRRIINESI KKLKRKPPSTNAGRRQKHRLTCPSC DSYEKKPPKEFLERFKSLLQKMIHQ HLSSRTHGSEDS | 1.53234003 | 2507 |
| IL-21_ 14314 | IL-21_ 6318 | H35F, K81D, V98E, P108W | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKRKPWSTNAGRRQKHRLTCPSC DSYEKKPPKEFLERFKSLLQKMIHQ HLSSRTHGSEDS | 1.534772893 | 2508 |
| IL-21_ 13178 | IL-21_ 6318 | H35F, I45Q, K81D, V98E | MRSSPGNMERIVICLMVIFLGTLVH KSSSQGQDRFMIRMRQLIDQVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 1.535863014 | 2509 |
| IL-21_ 11560 | IL-21_ 0910 | I45T, K81D, V98E, P108Q | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KKLKRKPQSTNAGRRQKHRLTCPSC DSYEKKPPKEFLERFKSLLQKMIHQ HLSSRTHGSEDS | 1.536138695 | 2510 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 12906 | IL-21_ 0910 | D33P, I45T, K81D, V98E | MRSSPGNMERIVICLMVIFLGTLVHKSSSQGQPRHMIRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 1.53836819 | 2511 |
| IL-21_ 18646 | IL-21_ 5707 | K81D, V98S, P107V | MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINSSIKKLKRKVPSTNAGRRQKHRLTCPSCDSYEKKPPKEFLERFKSLLQKMIHQHLSSRTHGSEDS | 1.549471445 | 2512 |
| IL-21_ 20095 | IL-21_ 5474 | N70G, K81D, 195R, R114Q, R115D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERRINVSIKKLKRKPPSTNAGQDQKHRLTCPSCDSYEKKPPKEFLERFKSLLQKMIHQHLSSRTHGSEDS | 1.55071588 | 2513 |
| IL-21_ 18314 | IL-21_ 5707 | Q80G, K81D, V98E, P107V | MRSSPGNMERIVICLMVIFLGTLVHKSSSQGQDRHMIRMRQLIDIVDQLKNYVNDLVPEFLPAPEDVETNCEWSAFSCFGDAQLKSANTGNNERIINESIKKLKRKVPSTNAGRRQKHRLTCPSCDSYEKKPPKEFLERFKSLLQKMIHQHLSSRTHGSEDS | 1.556806268 | 2514 |
| IL-21_ 17740 | IL-21_ 5707 | Q48K, K81D, V98E, P107V | MRSSPGNMERIVICLMVIFLGTLVHKSSSQGQDRHMIRMRQLIDIVDKLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS | 1.56151121 | 2515 |
| IL-21_ 17541 | IL-21_ 5707 | I37H, K81D, V98E, P107V | MRSSPGNMERIVICLMVIFLGTLVHKSSSQGQDRHMHRMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS | 1.562356041 | 2516 |
| IL-21_ 12972 | IL-21_ 6318 | R34D, H35F, K81D, V98E | MRSSPGNMERIVICLMVIFLGTLVHKSSSQGQDDEMIRMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 1.570789486 | 2517 |
| IL-21_ 14209 | IL-21_ 6318 | H35F, K81D, V98E, L103A | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKAKRKPPSTNAGRRQKHRLTCPSCDSYEKKPPKEFLERFKSLLQKMIHQHLSSRTHGSEDS | 1.572191517 | 2518 |
| IL-21_ 17470 | IL-21_ 5707 | D33H, K81D, V98E, P107 | MRSSPGNMERIVICLMVIFLGTLVHKSSSQGQHRHMIRMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS | 1.573981072 | 2519 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 19821 | IL-21_ 5474 | N70G, Q80K, K81D, R114Q, R115D | MRSSPGNMERIVICLMVIFLGTLVH KSSSQGQDRHMIRMRQLIDIVDQLK NYVNDLVPEFLPAPEDVETGCEWSA FSCFKDAQLKSANTGNNERIINVSI KKLKRKPPSTNAGQDQKHRLTCPSC DSYEKKPPKEFLERFKSLLQKMIHQ HLSSRTHGSEDS | 1.577110892 | 2520 |
| IL-21_ 19041 | IL-21_ 5474 | I37E, N70G, K81D, R114Q, R115D | MRSSPGNMERIVICLMVIFLGTLVH KSSSQGQDRHMERMRQLIDIVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 1.577482361 | 2521 |
| IL-21_ 19001 | IL-21_ 5474 | R34W, N70G, K81D, R114Q, R115D | MRSSPGNMERIVICLMVIFLGTLVH KSSSQGQDWHMIRMRQLIDIVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 1.577997468 | 2522 |
| IL-21_ 12138 | IL-21_ 0910 | I45T, F76L, K81D, V98E | MRSSPGNMERIVICLMVIFLGTLVH KSSSQGQDRHMIRMRQLIDTVDQLK NYVNDLVPEFLPAPEDVETNCEWSA LSCFQDAQLKSANTGNNERIINESI KKLKRKPPSTNAGRRQKHRLTCPSC DSYEKKPPKEFLERFKSLLQKMIHQ HLSSRTHGSEDS | 1.580018355 | 2523 |
| IL-21_ 14542 | IL-21_ 6018 | H35F, R38A, K81D, V98E, T110D | MRSSPGNMERIVICLMVIFLGTLVH KSSSQGQDREMIAMRQLIDIVDQLK NYVNDLVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 1.582651145 | 2524 |
| IL-21_ 17691 | IL-21_ 5707 | I45Q, K81D, V98E, P107V | MRSSPGNMERIVICLMVIFLGTLVH KSSSQGQDRHMIRMRQLIDQVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 1.583475419 | 2525 |
| IL-21_ 12884 | IL-21_ 0910 | R34T, I45T, K81D, V98E | MRSSPGNMERIVICLMVIFLGTLVH KSSSQGQDTHMIRMRQLIDTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 1.584919005 | 2526 |
| IL-21_ 13170 | IL-21_ 6318 | H35F, I45F, K81D, V98E | MRSSPGNMERIVICLMVIFLGTLVH KSSSQGQDRFMIRMRQLIDFVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 1.586291424 | 2527 |
| IL-21_ 20166 | IL-21_ 5474 | N70G, K81D, S99P, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVPI KKLKRKPPSTNAGQDQKHRLTCPSC DSYEKKPPKEFLERFKSLLQKMIHQ HLSSRTHGSEDS | 1.586672575 | 2528 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 11694 | IL-21_ 0910 | I45T, K81D, V98E, K101E | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI EKLKRKPPSTNAGRRQKHRLTCPSC DSYEKKPPKEFLERFKSLLQKMIHQ HLSSRTHGSEDS | 1.589590958 | 2529 |
| IL-21_ 19079 | IL-21_ 5474 | M39G, N70G, K81D, R114Q, R115D | MRSSPGNMERIVICLMVIFLGTLVH KSSSQGQDRHMIRGRQLIDIVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 1.590567897 | 2530 |
| IL-21_ 12887 | IL-21_ 0910 | R34P, I45T, K81D, V98E | MRSSPGNMERIVICLMVIFLGTLVH KSSSQGQDPHMIRMRQLIDTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 1.591612429 | 2531 |
| IL-21_ 19817 | IL-21_ 5474 | N70G, Q80F, K81D, R114Q, R115D | MRSSPGNMERIVICLMVIFLGTLVH KSSSQGQDRHMIRMRQLIDIVDQLK NYVNDLVPEFLPAPEDVETGCEWSA FSCFFDAQLKSANTGNNERIINVSI KKLKRKPPSTNAGQDQKHRLTCPSC DSYEKKPPKEFLERFKSLLQKMIHQ HLSSRTHGSEDS | 1.60352385 | 2532 |
| IL-21_ 18352 | IL-21_ 5707 | K81D, A82L, V98E, P107V | MRSSPGNMERIVICLMVIFLGTLVH KSSSQGQDRHMIRMRQLIDIVDQLK NYVNDLVPEFLPAPEDVETNCEWSA FSCFQDLQLKSANTGNNERIINESI KKLKRKVPSTNAGRRQKHRLTCPSC DSYEKKPPKEFLERFKSLLQKMIHQ HLSSRTHGSEDS | 1.604339748 | 2533 |
| IL-21_ 10375 | IL-21_ 3610 | V53T, P107V, R114Q, R115D | MRSSPGNMERIVICLMVIFLGTLVH KSSSQGQDRHMIRMRQLIDIVDQLK NYTNDLVPEFLPAPEDVETNCEWSA FSCFQKAQLKSANTGNNERIINVSI KKLKRKVPSTNAGQDQKHRLTCPSC DSYEKKPPKEFLERFKSLLQKMIHQ HLSSRTHGSEDS | 1.607306576 | 2534 |
| IL-21_ 18350 | IL-21_ 5707 | K81D, A82I, V98E, P107V | MRSSPGNMERIVICLMVIFLGTLVH KSSSQGQDRHMIRMRQLIDIVDQLK NYVNDLVPEFLPAPEDVETNCEWSA FSCFQDIQLKSANTGNNERIINESI KKLKRKVPSTNAGRRQKHRLTCPSC DSYEKKPPKEFLERFKSLLQKMIHQ HLSSRTHGSEDS | 1.61694292 | 2535 |
| IL-21_ 18555 | IL-21_ 5707 | K81D, E93R, V98E, P107V | MRSSPGNMERIVICLMVIFLGTLVH KSSSQGQDRHMIRMRQLIDIVDQLK NYVNDLVPEFLPAPEDVETNCEWSA FSCFQDAQLKSANTGNNRRIINESI KKLKRKVPSTNAGRRQKHRLTCPSC DSYEKKPPKEFLERFKSLLQKMIHQ HLSSRTHGSEDS | 1.62109777 | 2536 |
| IL-21_ 11558 | IL-21_ 0910 | I45T, K81D, V98E, P108S | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KKLKRKPSSTNAGRRQKHRLTCPSC DSYEKKPPKEFLERFKSLLQKMIHQ HLSSRTHGSEDS | 1.622464182 | 2537 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 18641 | IL-21_ 5707 | K81D, V98M, P107V | MRSSPGNMERIVICLMVIFLGTLVH KSSSQGQDRHMIRMRQLIDIVDQLK NYVNDLVPEFLPAPEDVETNCEWSA FSCFQDAQLKSANTGNNERIINMSI KKLKRKVPSTNAGRRQKHRLTCPSC DSYEKKPPKEFLERFKSLLQKMIHQ HLSSRTHGSEDS | 1.626104963 | 2538 |
| IL-21_ 14087 | IL-21_ 6318 | H35F, K81D, 196F, V98E | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIENESI KKLKRKPPSTNAGRRQKHRLTCPSC DSYEKKPPKEFLERFKSLLQKMIHQ HLSSRTHGSEDS | 1.627234315 | 2539 |
| IL-21_ 19182 | IL-21_ 5474 | D44Y, N70G, K81D, R114Q, R115D | MRSSPGNMERIVICLMVIFLGTLVH KSSSQGQDRHMIRMRQLIYIVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 1.62880169 | 2540 |
| IL-21_ 18799 | IL-21_ 5707 | K81D, V98E, P107H | MRSSPGNMERIVICLMVIFLGTLVH KSSSQGQDRHMIRMRQLIDIVDQLK NYVNDLVPEFLPAPEDVETNCEWSA FSCFQDAQLKSANTGNNERIINESI KKLKRKHPSTNAGRRQKHRLTCPSC DSYEKKPPKEFLERFKSLLQKMIHQ HLSSRTHGSEDS | 1.629057359 | 2541 |
| IL-21_ 14168 | IL-21_ 6318 | H35F, K81D, V98E, I100S | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESS KKLKRKPPSTNAGRRQKHRLTCPSC DSYEKKPPKEFLERFKSLLQKMIHQ HLSSRTHGSEDS | 1.631039002 | 2542 |
| IL-21_ 15704 | IL-21_ 6018 | H35F, K81D, V98E, K102P, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KPLKRKPPSDNAGRRQKHRLTCPSC DSYEKKPPKEFLERFKSLLQKMIHQ HLSSRTHGSEDS | 1.631818856 | 2543 |
| IL-21_ 19853 | IL-21_ 5474 | N70G, K81D, A82H, R114Q, R115D | MRSSPGNMERIVICLMVIFLGTLVH KSSSQGQDRHMIRMRQLIDIVDQLK NYVNDLVPEFLPAPEDVETGCEWSA FSCFQDHQLKSANTGNNERIINVSI KKLKRKPPSTNAGQDQKHRLTCPSC DSYEKKPPKEFLERFKSLLQKMIHQ HLSSRTHGSEDS | 1.632038347 | 2544 |
| IL-21_ 18307 | IL-21_ 5707 | F79V, K81D, V98E, P107V | MRSSPGNMERIVICLMVIFLGTLVH KSSSQGQDRHMIRMRQLIDIVDQLK NYVNDLVPEFLPAPEDVETNCEWSA FSCVQDAQLKSANTGNNERIINESI KKLKRKVPSTNAGRRQKHRLTCPSC DSYEKKPPKEFLERFKSLLQKMIHQ HLSSRTHGSEDS | 1.632416107 | 2545 |
| IL-21_ 13045 | IL-21_ 6318 | H35F, R38G, K81D, V98E | MRSSPGNMERIVICLMVIFLGTLVH KSSSQGQDRFMIGMRQLIDIVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 1.633469804 | 2546 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 17670 | IL-21_ 5707 | D44M, K81D, V98E, P107V | MRSSPGNMERIVICLMVIFLGTLVH KSSSQGQDRHMIRMRQLIMIVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 1.640496046 | 2547 |
| IL-21_ 12130 | IL-21_ 0910 | I45T, F76V, K81D, V98E | MRSSPGNMERIVICLMVIFLGTLVH KSSSQGQDRHMIRMRQLIDTVDQLK NYVNDLVPEFLPAPEDVETNCEWSA VSCFQDAQLKSANTGNNERIINESI KKLKRKPPSTNAGRRQKHRLTCPSC DSYEKKPPKEFLERFKSLLQKMIHQ HLSSRTHGSEDS | 1.646210536 | 2548 |
| IL-21_ 17669 | IL-21_ 5707 | D44L, K81D, V98E, P107V | MRSSPGNMERIVICLMVIFLGTLVH KSSSQGQDRHMIRMRQLILIVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 1.646382709 | 2549 |
| IL-21_ 10661 | IL-21_ 3610 | I37W, P107V, R114Q, R115D | MRSSPGNMERIVICLMVIFLGTLVH KSSSQGQDRHMWRMRQLIDIVDQLK NYVNDLVPEFLPAPEDVETNCEWSA FSCFQKAQLKSANTGNNERIINVSI KKLKRKVPSTNAGQDQKHRLTCPSC DSYEKKPPKEFLERFKSLLQKMIHQ HLSSRTHGSEDS | 1.653871994 | 2550 |
| IL-21_ 14150 | IL-21_ 6318 | H35F, K81D, V98E, S99R | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINERI KKLKRKPPSTNAGRRQKHRLTCPSC DSYEKKPPKEFLERFKSLLQKMIHQ HLSSRTHGSEDS | 1.655819722 | 2551 |
| IL-21_ 14101 | IL-21_ 6318 | H35F, K81D, 196Y, V98E | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIYNESI KKLKRKPPSTNAGRRQKHRLTCPSC DSYEKKPPKEFLERFKSLLQKMIHQ HLSSRTHGSEDS | 1.6578084 | 2552 |
| IL-21_ 11567 | IL-21_ 0910 | I45T, K81D, V98E, P108G | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KKLKRKPGSTNAGRRQKHRLTCPSC DSYEKKPPKEFLERFKSLLQKMIHQ HLSSRTHGSEDS | 1.658597331 | 2553 |
| IL-21_ 10676 | IL-21_ 3610 | I37D, P107V, R114Q, R115D | MRSSPGNMERIVICLMVIFLGTLVH KSSSQGQDRHMDRMRQLIDIVDQLK NYVNDLVPEFLPAPEDVETNCEWSA FSCFQKAQLKSANTGNNERIINVSI KKLKRKVPSTNAGQDQKHRLTCPSC DSYEKKPPKEFLERFKSLLQKMIHQ HLSSRTHGSEDS | 1.661450518 | 2554 |
| IL-21_ 11571 | IL-21_ 0910 | I45T, K81D, V98E, P108A | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KKLKRKPASTNAGRRQKHRLTCPSC DSYEKKPPKEFLERFKSLLQKMIHQ HLSSRTHGSEDS | 1.663091164 | 2555 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 14530 | IL-21_ 6018 | H35F, I37K, K81D, V98E, T110D | MRSSPGNMERIVICLMVIFLGTLVH KSSSQGQDRFMKRMRQLIDIVDQLK NYVNDLVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 1.663277441 | 2556 |
| IL-21_ 12137 | IL-21_ 0910 | I45T, F76M, K81D, V98E | MRSSPGNMERIVICLMVIFLGTLVH KSSSQGQDRHMIRMRQLIDTVDQLK NYVNDLVPEFLPAPEDVETNCEWSA MSCFQDAQLKSANTGNNERIINESI KKLKRKPPSTNAGRRQKHRLTCPSC DSYEKKPPKEFLERFKSLLQKMIHQ HLSSRTHGSEDS | 1.664919533 | 2557 |
| IL-21_ 17545 | IL-21_ 5707 | I37N, K81D, V98E, P107V | MRSSPGNMERIVICLMVIFLGTLVH KSSSQGQDRHMNRMRQLIDIVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 1.670752567 | 2558 |
| IL-21_ 19073 | IL-21_ 5474 | R38W, N70G, K81D, R114Q, R115D | MRSSPGNMERIVICLMVIFLGTLVH KSSSQGQDRHMIWMRQLIDIVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 1.67455096 | 2559 |
| IL-21_ 13035 | IL-21_ 6318 | H35F, I37R, K81D, V98E | MRSSPGNMERIVICLMVIFLGTLVH KSSSQGQDRFMRRMRQLIDIVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 1.675654287 | 2560 |
| IL-21_ 12832 | IL-21_ 0910 | I37T, I45T, K81D, V98E | MRSSPGNMERIVICLMVIFLGTLVH KSSSQGQDRHMTRMRQLIDTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 1.6814949 | 2561 |
| IL-21_ 14551 | IL-21_ 6018 | H35F, R38M, K81D, V98E, T110D | MRSSPGNMERIVICLMVIFLGTLVH KSSSQGQDRFMIMMRQLIDIVDQLK NYVNDLVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 1.681741838 | 2562 |
| IL-21_ 20129 | IL-21_ 5474 | N70G, K81D, N97P, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIIPVSI KKLKRKPPSTNAGQDQKHRLTCPSC DSYEKKPPKEFLERFKSLLQKMIHQ HLSSRTHGSEDS | 1.683695788 | 2563 |
| IL-21_ 10520 | IL-21_ 3610 | I45S, P107V, R114Q, R115D | MRSSPGNMERIVICLMVIFLGTLVH KSSSQGQDRHMIRMRQLIDSVDQLK NYVNDLVPEFLPAPEDVETNCEWSA FSCFQKAQLKSANTGNNERIINVSI KKLKRKVPSTNAGQDQKHRLTCPSC DSYEKKPPKEFLERFKSLLQKMIHQ HLSSRTHGSEDS | 1.683769767 | 2564 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 11674 | IL-21_ 0910 | I45T, K81D, V98E, K102G | MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKGLKRKPPSTNAGRRQKHRLTCPSCDSYEKKPPKEFLERFKSLLQKMIHQHLSSRTHGSEDS | 1.68671297 | 2565 |
| IL-21_ 11695 | IL-21_ 0910 | I45T, K81D, V98E, K101D | MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIDKLKRKPPSTNAGRRQKHRLTCPSCDSYEKKPPKEFLERFKSLLQKMIHQHLSSRTHGSEDS | 1.689515919 | 2566 |
| IL-21_ 12772 | IL-21_ 0910 | Q41E, I45T, K81D, V98E | MRSSPGNMERIVICLMVIFLGTLVHKSSSQGQDRHMIRMRELIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 1.690581322 | 2567 |
| IL-21_ 17540 | IL-21_ 5707 | I37G, K81D, V98E, P107V | MRSSPGNMERIVICLMVIFLGTLVHKSSSQGQDRHMGRMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS | 1.69194705 | 2568 |
| IL-21_ 19369 | IL-21_ 5474 | D55K, N70G, K81D, R114Q, R115D | MRSSPGNMERIVICLMVIFLGTLVHKSSSQGQDRHMIRMRQLIDIVDQLKNYVNKLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS | 1.694054594 | 2569 |
| IL-21_ 18379 | IL-21_ 5707 | K81D, Q83W, V98E, P107V | MRSSPGNMERIVICLMVIFLGTLVHKSSSQGQDRHMIRMRQLIDIVDQLKNYVNDLVPEFLPAPEDVETNCEWSAFSCFQDAWLKSANTGNNERIINESIKKLKRKVPSTNAGRRQKHRLTCPSCDSYEKKPPKEFLERFKSLLQKMIHQHLSSRTHGSEDS | 1.695897592 | 2570 |
| IL-21_ 11797 | IL-21_ 0910 | I45T, K81D, I95K, V98E | MRSSPGNMERIVICLMVIFLGTLVHKSSSQGQDRHMIRMRQLIDTVDQLKNYVNDLVPEFLPAPEDVETNCEWSAFSCFQDAQLKSANTGNNERKINESIKKLKRKPPSTNAGRRQKHRLTCPSCDSYEKKPPKEFLERFKSLLQKMIHQHLSSRTHGSEDS | 1.697113245 | 2571 |
| IL-21_ 9397 | IL-21_ 3610 | P107V, P108H, R114Q, R115D | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVHSTNAGQDQKHRLTCPSCDSYEKKPPKEFLERFKSLLQKMIHQHLSSRTHGSEDS | 1.699215785 | 2572 |
| IL-21_ 9377 | IL-21_ 3610 | P107V, S109K, R114Q, R115D | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPKTNAGQDQKHRLTCPSCDSYEKKPPKEFLERFKSLLQKMIHQHLSSRTHGSEDS | 1.699399491 | 2573 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 15725 | IL-21_ 6018 | H35F, K81D, V98E, L103S, T110D | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKSKRKPPSDNAGRRQKHRLTCPSCDSYEKKPPKEFLERFKSLLQKMIHQHLSSRTHGSEDS | 1.705571714 | 2574 |
| IL-21_ 14644 | IL-21_ 6018 | H35F, I43R, K81D, V98E, T110D | MRSSPGNMERIVICLMVIFLGTLVHKSSSQGQDRFMIRMRQLRDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS | 1.706755615 | 2575 |
| IL-21_ 13165 | IL-21_ 6318 | H35F, D44W, K81D, V98E | MRSSPGNMERIVICLMVIFLGTLVHKSSSQGQDRFMIRMRQLIWIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 1.71033211 | 2576 |
| IL-21_ 12965 | IL-21_ 6318 | D33R, H35F, K81D, V98E | MRSSPGNMERIVICLMVIFLGTLVHKSSSQGQRRFMIRMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 1.71167565 | 2577 |
| IL-21_ 19375 | IL-21_ 5474 | D55R, N70G, K81D, R114Q, R115D | MRSSPGNMERIVICLMVIFLGTLVHKSSSQGQDRHMIRMRQLIDIVDQLKNYVNRLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS | 1.714481786 | 2578 |
| IL-21_ 5833 | IL-21_ 5707 | K81D, P107V | MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGRRQKHRLTCPSCDSYEKKPPKEFLERFKSLLQKMIHQHLSSRTHGSEDS | 1.725065364 | 2579 |
| IL-21_ 18647 | IL-21_ 5707 | K81D, V98T, P107V | MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINTSIKKLKRKVPSTNAGRRQKHRLTCPSCDSYEKKPPKEFLERFKSLLQKMIHQHLSSRTHGSEDS | 1.733252549 | 2580 |
| IL-21_ 13167 | IL-21_ 6318 | H35F, I45A, K81D, V98E | MRSSPGNMERIVICLMVIFLGTLVHKSSSQGQDRFMIRMRQLIDAVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 1.733313396 | 2581 |
| IL-21_ 14223 | IL-21_ 6318 | H35F, K81D, V98E, L103T | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKTKRKPPSTNAGRRQKHRLTCPSCDSYEKKPPKEFLERFKSLLQKMIHQHLSSRTHGSEDS | 1.73562517 | 2582 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 20230 | IL-21_ 5474 | N70G, K81D, L103F, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKEKRKPPSTNAGQDQKHRLTCPSC DSYEKKPPKEFLERFKSLLQKMIHQ HLSSRTHGSEDS | 1.735966996 | 2583 |
| IL-21_ 10641 | IL-21_ 3610 | M39A, P107V, R114Q, R115D | MRSSPGNMERIVICLMVIFLGTLVH KSSSQGQDRHMIRARQLIDIVDQLK NYVNDLVPEFLPAPEDVETNCEWSA FSCFQKAQLKSANTGNNERIINVSI KKLKRKVPSTNAGQDQKHRLTCPSC DSYEKKPPKEFLERFKSLLQKMIHQ HLSSRTHGSEDS | 1.736631431 | 2584 |
| IL-21_ 18657 | IL-21_ 5707 | K81D, V98E, S99K, P107V | MRSSPGNMERIVICLMVIFLGTLVH KSSSQGQDRHMIRMRQLIDIVDQLK NYVNDLVPEFLPAPEDVETNCEWSA FSCFQDAQLKSANTGNNERIINEKI KKLKRKVPSTNAGRRQKHRLTCPSC DSYEKKPPKEFLERFKSLLQKMIHQ HLSSRTHGSEDS | 1.736920606 | 2585 |
| IL-21_ 12140 | IL-21_ 0910 | I45T, F76I, K81D, V98E | MRSSPGNMERIVICLMVIFLGTLVH KSSSQGQDRHMIRMRQLIDTVDQLK NYVNDLVPEFLPAPEDVETNCEWSA ISCFQDAQLKSANTGNNERIINESI KKLKRKPPSTNAGRRQKHRLTCPSC DSYEKKPPKEFLERFKSLLQKMIHQ HLSSRTHGSEDS | 1.740073703 | 2586 |
| IL-21_ 19830 | IL-21_ 5474 | N70G, Q80W, K81D, R114Q, R115D | MRSSPGNMERIVICLMVIFLGTLVH KSSSQGQDRHMIRMRQLIDIVDQLK NYVNDLVPEFLPAPEDVETGCEWSA FSCFWDAQLKSANTGNNERIINVSI KKLKRKPPSTNAGQDQKHRLTCPSC DSYEKKPPKEFLERFKSLLQKMIHQ HLSSRTHGSEDS | 1.741388477 | 2587 |
| IL-21_ 15765 | IL-21_ 6018 | H35F, K81D, V98E, R105Y, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKYKPPSDNAGRRQKHRLTCPSC DSYEKKPPKEFLERFKSLLQKMIHQ HLSSRTHGSEDS | 1.745539562 | 2588 |
| IL-21_ 17684 | IL-21_ 5707 | I45G, K81D, V98E, P107V | MRSSPGNMERIVICLMVIFLGTLVH KSSSQGQDRHMIRMRQLIDGVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 1.748118414 | 2589 |
| IL-21_ 11584 | IL-21_ 0910 | I45T, K81D, V98E, P107G | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KKLKRKGPSTNAGRRQKHRLTCPSC DSYEKKPPKEFLERFKSLLQKMIHQ HLSSRTHGSEDS | 1.750783932 | 2590 |
| IL-21_ 15635 | IL-21_ 6018 | H35F, K81D, V98R, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINRSI KKLKRKPPSDNAGRRQKHRLTCPSC DSYEKKPPKEFLERFKSLLQKMIHQ HLSSRTHGSEDS | 1.75093725 | 2591 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 13166 | IL-21_ 6318 | H35F, D44Y, K81D, V98E | MRSSPGNMERIVICLMVIFLGTLVHKSSSQGQDRFMIRMRQLIYIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 1.751116739 | 2592 |
| IL-21_ 18806 | IL-21_ 5707 | K81D, V98E, P107R | MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKRPSTNAGRRQKHRLTCPSCDSYEKKPPKEFLERFKSLLQKMIHQHLSSRTHGSEDS | 1.758229766 | 2593 |
| IL-21_ 19815 | IL-21_ 5474 | N70G, Q80D, K81D, R114Q, R115D | MRSSPGNMERIVICLMVIFLGTLVHKSSSQGQDRHMIRMRQLIDIVDQLKNYVNDLVPEFLPAPEDVETGCEWSAFSCFDDAQLKSANTGNNERIINVSIKKLKRKPPSTNAGQDQKHRLTCPSCDSYEKKPPKEFLERFKSLLQKMIHQHLSSRTHGSEDS | 1.760647271 | 2594 |
| IL-21_ 15756 | IL-21_ 6018 | H35F, K81D, V98E, R105L, T110D | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKLKPPSDNAGRRQKHRLTCPSCDSYEKKPPKEFLERFKSLLQKMIHQHLSSRTHGSEDS | 1.760945616 | 2595 |
| IL-21_ 19747 | IL-21_ 5474 | N70G, F76K, K81D, R114Q, R115D | MRSSPGNMERIVICLMVIFLGTLVHKSSSQGQDRHMIRMRQLIDIVDQLKNYVNDLVPEFLPAPEDVETGCEWSAKSCFQDAQLKSANTGNNERIINVSIKKLKRKPPSTNAGQDQKHRLTCPSCDSYEKKPPKEFLERFKSLLQKMIHQHLSSRTHGSEDS | 1.761102517 | 2596 |
| IL-21_ 9419 | IL-21_ 3610 | P107A, R114Q, R115D | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKAPSTNAGQDQKHRLTCPSCDSYEKKPPKEFLERFKSLLQKMIHQHLSSRTHGSEDS | 1.763253985 | 2597 |
| IL-21_ 12773 | IL-21_ 0910 | Q41D, I45T, K81D, V98E | MRSSPGNMERIVICLMVIFLGTLVHKSSSQGQDRHMIRMRDLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 1.763649727 | 2598 |
| IL-21_ 10659 | IL-21_ 3610 | R38A, P107V, R114Q, R115D | MRSSPGNMERIVICLMVIFLGTLVHKSSSQGQDRHMIAMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS | 1.772571 | 2599 |
| IL-21_ 19043 | IL-21_ 5474 | I37G, N70G, K81D, R114Q, R115D | MRSSPGNMERIVICLMVIFLGTLVHKSSSQGQDRHMGRMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS | 1.783864414 | 2600 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 20255 | IL-21_ 5474 | N70G, K81D, K104P, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLPRKPPSTNAGQDQKHRLTCPSC DSYEKKPPKEFLERFKSLLQKMIHQ HLSSRTHGSEDS | 1.784483903 | 2601 |
| IL-21_ 18818 | IL-21_ 5707 | K81D, V98E, P107V, P108K | MRSSPGNMERIVICLMVIFLGTLVH KSSSQGQDRHMIRMRQLIDIVDQLK NYVNDLVPEFLPAPEDVETNCEWSA FSCFQDAQLKSANTGNNERIINESI KKLKRKVKSTNAGRRQKHRLTCPSC DSYEKKPPKEFLERFKSLLQKMIHQ HLSSRTHGSEDS | 1.784954835 | 2602 |
| IL-21_ 9438 | IL-21_ 3610 | R105Y, P107V, R114Q, R115D | MRSSPGNMERIVICLMVIFLGTLVH KSSSQGQDRHMIRMRQLIDIVDQLK NYVNDLVPEFLPAPEDVETNCEWSA FSCFQKAQLKSANTGNNERIINVSI KKLKYKVPSTNAGQDQKHRLTCPSC DSYEKKPPKEFLERFKSLLQKMIHQ HLSSRTHGSEDS | 1.786129956 | 2603 |
| IL-21_ 19167 | IL-21_ 5474 | D44F, N70G, K81D, R114Q, R115D | MRSSPGNMERIVICLMVIFLGTLVH KSSSQGQDRHMIRMRQLIFIVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 1.788776762 | 2604 |
| IL-21_ 17664 | IL-21_ 5707 | D44F, K81D, V98E, P107V | MRSSPGNMERIVICLMVIFLGTLVH KSSSQGQDRHMIRMRQLIFIVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 1.7905758 | 2605 |
| IL-21_ 17566 | IL-21_ 5707 | R38Q, K81D, V98E, P107V | MRSSPGNMERIVICLMVIFLGTLVH KSSSQGQDRHMIQMRQLIDIVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 1.807290972 | 2606 |
| IL-21_ 14124 | IL-21_ 6318 | H35F, K81D, V98H | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINHSI KKLKRKPPSTNAGRRQKHRLTCPSC DSYEKKPPKEFLERFKSLLQKMIHQ HLSSRTHGSEDS | 1.816652324 | 2607 |
| IL-21_ 12881 | IL-21_ 0910 | R34Y, I45T, K81D, V98E | MRSSPGNMERIVICLMVIFLGTLVH KSSSQGQDYHMIRMRQLIDTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 1.821879136 | 2608 |
| IL-21_ 18366 | IL-21_ 5707 | K81D, Q83F, V98E, P107V | MRSSPGNMERIVICLMVIFLGTLVH KSSSQGQDRHMIRMRQLIDIVDQLK NYVNDLVPEFLPAPEDVETNCEWSA FSCFQDAFLKSANTGNNERIINESI KKLKRKVPSTNAGRRQKHRLTCPSC DSYEKKPPKEFLERFKSLLQKMIHQ HLSSRTHGSEDS | 1.828017878 | 2609 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 14743 | IL-21_ 6018 | H35F, L49F, K81D, V98E, T110D | MRSSPGNMERIVICLMVIFLGTLVH KSSSQGQDRFMIRMRQLIDIVDQFK NYVNDLVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 1.834490433 | 2610 |
| IL-21_ 18649 | IL-21_ 5707 | K81D, V98Y, P107V | MRSSPGNMERIVICLMVIFLGTLVH KSSSQGQDRHMIRMRQLIDIVDQLK NYVNDLVPEFLPAPEDVETNCEWSA FSCFQDAQLKSANTGNNERIINYSI KKLKRKVPSTNAGRRQKHRLTCPSC DSYEKKPPKEFLERFKSLLQKMIHQ HLSSRTHGSEDS | 1.83490278 | 2611 |
| IL-21_ 12893 | IL-21_ 0910 | R34H, I45T, K81D, V98E | MRSSPGNMERIVICLMVIFLGTLVH KSSSQGQDHHMIRMRQLIDTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 1.841821826 | 2612 |
| IL-21_ 18986 | IL-21_ 5474 | R34D, N70G, K81D, R114Q, R115D | MRSSPGNMERIVICLMVIFLGTLVH KSSSQGQDDHMIRMRQLIDIVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 1.844032452 | 2613 |
| IL-21_ 18775 | IL-21_ 5707 | K81D, V98E, R105Y, P107V | MRSSPGNMERIVICLMVIFLGTLVH KSSSQGQDRHMIRMRQLIDIVDQLK NYVNDLVPEFLPAPEDVETNCEWSA FSCFQDAQLKSANTGNNERIINESI KKLKYKVPSTNAGRRQKHRLTCPSC DSYEKKPPKEFLERFKSLLQKMIHQ HLSSRTHGSEDS | 1.846762744 | 2614 |
| IL-21_ 19819 | IL-21_ 5474 | N70G, Q80H, K81D, R114Q, R115D | MRSSPGNMERIVICLMVIFLGTLVH KSSSQGQDRHMIRMRQLIDIVDQLK NYVNDLVPEFLPAPEDVETGCEWSA FSCFHDAQLKSANTGNNERIINVSI KKLKRKPPSTNAGQDQKHRLTCPSC DSYEKKPPKEFLERFKSLLQKMIHQ HLSSRTHGSEDS | 1.848014472 | 2615 |
| IL-21_ 13159 | IL-21_ 6318 | H35F, D44P, K81D, V98E | MRSSPGNMERIVICLMVIFLGTLVH KSSSQGQDRFMIRMRQLIPIVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 1.848667405 | 2616 |
| IL-21_ 17665 | IL-21_ 5707 | D44G, K81D, V98E, P107V | MRSSPGNMERIVICLMVIFLGTLVH KSSSQGQDRHMIRMRQLIGIVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 1.852204231 | 2617 |
| IL-21_ 12898 | IL-21_ 0910 | R34A, I45T, K81D, V98E | MRSSPGNMERIVICLMVIFLGTLVH KSSSQGQDAHMIRMRQLIDTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 1.852558397 | 2618 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 19913 | IL-21_ 5474 | N70G, K81D, K85P, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLPSANTGNNERIINVSI KKLKRKPPSTNAGQDQKHRLTCPSC DSYEKKPPKEFLERFKSLLQKMIHQ HLSSRTHGSEDS | 1.853716812 | 2619 |
| IL-21_ 11671 | IL-21_ 0910 | I45T, K81D, V98E, K102L | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KLLKRKPPSTNAGRRQKHRLTCPSC DSYEKKPPKEFLERFKSLLQKMIHQ HLSSRTHGSEDS | 1.866530475 | 2620 |
| IL-21_ 11602 | IL-21_ 0910 | I45T, K81D, V98E, K106G | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KKLKRGPPSTNAGRRQKHRLTCPSC DSYEKKPPKEFLERFKSLLQKMIHQ HLSSRTHGSEDS | 1.869008011 | 2621 |
| IL-21_ 18663 | IL-21_ 5707 | K81D, V98E, S99R, P107V | MRSSPGNMERIVICLMVIFLGTLVH KSSSQGQDRHMIRMRQLIDIVDQLK NYVNDLVPEFLPAPEDVETNCEWSA FSCFQDAQLKSANTGNNERIINERI KKLKRKVPSTNAGRRQKHRLTCPSC DSYEKKPPKEFLERFKSLLQKMIHQ HLSSRTHGSEDS | 1.876258345 | 2622 |
| IL-21_ 11569 | IL-21_ 0910 | I45T, K81D, V98E, P108E | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KKLKRKPESTNAGRRQKHRLTCPSC DSYEKKPPKEFLERFKSLLQKMIHQ HLSSRTHGSEDS | 1.888853469 | 2623 |
| IL-21_ 12706 | IL-21_ 0910 | D44T, I45T, K81D, V98E | MRSSPGNMERIVICLMVIFLGTLVH KSSSQGQDRHMIRMRQLITTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 1.904052184 | 2624 |
| IL-21_ 11554 | IL-21_ 0910 | I45T, K81D, V98E, P108Y | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KKLKRKPYSTNAGRRQKHRLTCPSC DSYEKKPPKEFLERFKSLLQKMIHQ HLSSRTHGSEDS | 1.916642621 | 2625 |
| IL-21_ 17679 | IL-21_ 5707 | D44Y, K81D, V98E, P107V | MRSSPGNMERIVICLMVIFLGTLVH KSSSQGQDRHMIRMRQLIYIVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 1.917438735 | 2626 |
| IL-21_ 12843 | IL-21_ 0910 | I37F, I45T, K81D, V98E | MRSSPGNMERIVICLMVIFLGTLVH KSSSQGQDRHMFRMRQLIDTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 1.928208091 | 2627 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 5823 | IL-21_ 5707 | V98E, P107V | MRSSPGNMERIVICLMVIFLGTLVH KSSSQGQDRHMIRMRQLIDIVDQLK NYVNDLVPEFLPAPEDVETNCEWSA FSCFQKAQLKSANTGNNERIINESI KKLKRKVPSTNAGRRQKHRLTCPSC DSYEKKPPKEFLERFKSLLQKMIHQ HLSSRTHGSEDS | 1.929634795 | 2628 |
| IL-21_ 14549 | IL-21_ 6018 | H35F, R38K, K81D, V98E, T110D | MRSSPGNMERIVICLMVIFLGTLVH KSSSQGQDRFMIKMRQLIDIVDQLK NYVNDLVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 1.941003163 | 2629 |
| IL-21_ 12043 | IL-21_ 0910 | I45T, K81R, V98E | MRSSPGNMERIVICLMVIFLGTLVH KSSSQGQDRHMIRMRQLIDTVDQLK NYVNDLVPEFLPAPEDVETNCEWSA FSCFQRAQLKSANTGNNERIINESI KKLKRKPPSTNAGRRQKHRLTCPSC DSYEKKPPKEFLERFKSLLQKMIHQ HLSSRTHGSEDS | 1.94492025 | 2630 |
| IL-21_ 9713 | IL-21_ 3610 | G90Q, P107V, R114Q, R115D | MRSSPGNMERIVICLMVIFLGTLVH KSSSQGQDRHMIRMRQLIDIVDQLK NYVNDLVPEFLPAPEDVETNCEWSA FSCFQKAQLKSANTQNNERIINVSI KKLKRKVPSTNAGQDQKHRLTCPSC DSYEKKPPKEFLERFKSLLQKMIHQ HLSSRTHGSEDS | 1.945741822 | 2631 |
| IL-21_ 12720 | IL-21_ 0910 | D44A, I45T, K81D, V98E | MRSSPGNMERIVICLMVIFLGTLVH KSSSQGQDRHMIRMRQLIATVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 1.966844929 | 2632 |
| IL-21_ 18766 | IL-21_ 5707 | K81D, V98E, R105L, P107V | MRSSPGNMERIVICLMVIFLGTLVH KSSSQGQDRHMIRMRQLIDIVDQLK NYVNDLVPEFLPAPEDVETNCEWSA FSCFQDAQLKSANTGNNERIINESI KKLKLKVPSTNAGRRQKHRLTCPSC DSYEKKPPKEFLERFKSLLQKMIHQ HLSSRTHGSEDS | 1.967064093 | 2633 |
| IL-21_ 14621 | IL-21_ 6018 | H35F, L42K, K81D, V98E, T110D | MRSSPGNMERIVICLMVIFLGTLVH KSSSQGQDRFMIRMRQKIDIVDQLK NYVNDLVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 1.973653405 | 2634 |
| IL-21_ 17563 | IL-21_ 5707 | R38M, K81D, V98E, P107V | MRSSPGNMERIVICLMVIFLGTLVH KSSSQGQDRHMIMMRQLIDIVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 1.974843424 | 2635 |
| IL-21_ 9447 | IL-21_ 3610 | R105L, P107V, R114Q, R115D | MRSSPGNMERIVICLMVIFLGTLVH KSSSQGQDRHMIRMRQLIDIVDQLK NYVNDLVPEFLPAPEDVETNCEWSA FSCFQKAQLKSANTGNNERIINVSI KKLKLKVPSTNAGQDQKHRLTCPSC DSYEKKPPKEFLERFKSLLQKMIHQ HLSSRTHGSEDS | 1.977922998 | 2636 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 18339 | IL-21_ 5707 | K81R, V98E, P107V | MRSSPGNMERIVICLMVIFLGTLVH KSSSQGQDRHMIRMRQLIDIVDQLK NYVNDLVPEFLPAPEDVETNCEWSA FSCFQRAQLKSANTGNNERIINESI KKLKRKVPSTNAGRRQKHRLTCPSC DSYEKKPPKEFLERFKSLLQKMIHQ HLSSRTHGSEDS | 1.985918259 | 2637 |
| IL-21_ 19895 | IL-21_ 5474 | N70G, K81D, L84P, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQPKSANTGNNERIINVSI KKLKRKPPSTNAGQDQKHRLTCPSC DSYEKKPPKEFLERFKSLLQKMIHQ HLSSRTHGSEDS | 1.998621431 | 2638 |
| IL-21_ 17570 | IL-21_ 5707 | R38W, K81D, V98E, P107V | MRSSPGNMERIVICLMVIFLGTLVH KSSSQGQDRHMIWMRQLIDIVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 2.00707852 | 2639 |
| IL-21_ 10673 | IL-21_ 3610 | I37G, P107V, R114Q, R115D | MRSSPGNMERIVICLMVIFLGTLVH KSSSQGQDRHMGRMRQLIDIVDQLK NYVNDLVPEFLPAPEDVETNCEWSA FSCFQKAQLKSANTGNNERIINVSI KKLKRKVPSTNAGQDQKHRLTCPSC DSYEKKPPKEFLERFKSLLQKMIHQ HLSSRTHGSEDS | 2.007511318 | 2640 |
| IL-21_ 20162 | IL-21_ 5474 | N70G, K81D, S99K, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVKI KKLKRKPPSTNAGQDQKHRLTCPSC DSYEKKPPKEFLERFKSLLQKMIHQ HLSSRTHGSEDS | 2.018535778 | 2641 |
| IL-21_ 19051 | IL-21_ 5474 | I37R, N70G, K81D, R114Q, R115D | MRSSPGNMERIVICLMVIFLGTLVH KSSSQGQDRHMRRMRQLIDIVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 2.021430425 | 2642 |
| IL-21_ 20270 | IL-21_ 5474 | N70G, K81D, R105K, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKKKPPSTNAGQDQKHRLTCPSC DSYEKKPPKEFLERFKSLLQKMIHQ HLSSRTHGSEDS | 2.024439352 | 2643 |
| IL-21_ 12841 | IL-21_ 0910 | I37H, I45T, K81D, V98E | MRSSPGNMERIVICLMVIFLGTLVH KSSSQGQDRHMHRMRQLIDTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 2.031647072 | 2644 |
| IL-21_ 14288 | IL-21_ 6318 | H35F, K81D, V98E, P107K | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKRKKPSTNAGRRQKHRLTCPSC DSYEKKPPKEFLERFKSLLQKMIHQ HLSSRTHGSEDS | 2.040750453 | 2645 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 7545 | IL-21_ 4177 | H35I, N70G, G90Q, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTQNNERIINVSI KKLKRKPPSDNPGRRQKHRLTCPSC DSYEKKPPKEFLERFKSLLQKMIHQ HLSSRTHGSEDS | 2.049793877 | 2646 |
| IL-21_ 13182 | IL-21_ 6318 | H35F, I45W, K81D, V98E | MRSSPGNMERIVICLMVIFLGTLVH KSSSQGQDRFMIRMRQLIDWVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 2.053724225 | 2647 |
| IL-21_ 15597 | IL-21_ 6018 | H35F, K81D, 196P, V98E, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIPNESI KKLKRKPPSDNAGRRQKHRLTCPSC DSYEKKPPKEFLERFKSLLQKMIHQ HLSSRTHGSEDS | 2.059603982 | 2648 |
| IL-21_ 13050 | IL-21_ 6318 | H35F, R38M, K81D, V98E | MRSSPGNMERIVICLMVIFLGTLVH KSSSQGQDRFMIMMRQLIDIVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 2.069162639 | 2649 |
| IL-21_ 20101 | IL-21_ 5474 | N70G, K81D, 196A, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIANVSI KKLKRKPPSTNAGQDQKHRLTCPSC DSYEKKPPKEFLERFKSLLQKMIHQ HLSSRTHGSEDS | 2.07037494 | 2650 |
| IL-21_ 7580 | IL-21_ 4177 | H35I, N70G, N88R, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSARTGNNERIINVSI KKLKRKPPSDNPGRRQKHRLTCPSC DSYEKKPPKEFLERFKSLLQKMIHQ HLSSRTHGSEDS | 2.07118802 | 2651 |
| IL-21_ 7140 | IL-21_ 4177 | H35I, N70G, T110D, A112P, G113H | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKRKPPSDNPHRRQKHRLTCPSC DSYEKKPPKEFLERFKSLLQKMIHQ HLSSRTHGSEDS | 2.073824213 | 2652 |
| IL-21_ 18763 | IL-21_ 5707 | K81D, V98E, R105H, P107V | MRSSPGNMERIVICLMVIFLGTLVH KSSSQGQDRHMIRMRQLIDIVDQLK NYVNDLVPEFLPAPEDVETNCEWSA FSCFQDAQLKSANTGNNERIINESI KKLKHKVPSTNAGRRQKHRLTCPSC DSYEKKPPKEFLERFKSLLQKMIHQ HLSSRTHGSEDS | 2.074659355 | 2653 |
| IL-21_ 7172 | IL-21_ 4177 | H35I, N70G, T110D, N111K, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKRKPPSDKPGRRQKHRLTCPSC DSYEKKPPKEFLERFKSLLQKMIHQ HLSSRTHGSEDS | 2.080648353 | 2654 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 17695 | IL-21_ 5707 | I45W, K81D, V98E, P107V | MRSSPGNMERIVICLMVIFLGTLVH KSSSQGQDRHMIRMRQLIDWVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 2.081701336 | 2655 |
| IL-21_ 19856 | IL-21_ 5474 | N70G, K81D, A82L, R114Q, R115D | MRSSPGNMERIVICLMVIFLGTLVH KSSSQGQDRHMIRMRQLIDIVDQLK NYVNDLVPEFLPAPEDVETGCEWSA FSCFQDLQLKSANTGNNERIINVSI KKLKRKPPSTNAGQDQKHRLTCPSC DSYEKKPPKEFLERFKSLLQKMIHQ HLSSRTHGSEDS | 2.082266996 | 2656 |
| IL-21_ 20103 | IL-21_ 5474 | N70G, K81D, 196E, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIENVSI KKLKRKPPSTNAGQDQKHRLTCPSC DSYEKKPPKEFLERFKSLLQKMIHQ HLSSRTHGSEDS | 2.088418702 | 2657 |
| IL-21_ 8501 | IL-21_ 4177 | H35I, I37P, N70G, T110D, A112P | MRSSPGNMERIVICLMVIFLGTLVH KSSSQGQDRIMPRMRQLIDIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.09005915 | 2658 |
| IL-21_ 13738 | IL-21_ 6318 | H35F, F76T, K81D, V98E | MRSSPGNMERIVICLMVIFLGTLVH KSSSQGQDRFMIRMRQLIDIVDQLK NYVNDLVPEFLPAPEDVETNCEWSA TSCFQDAQLKSANTGNNERIINESI KKLKRKPPSTNAGRRQKHRLTCPSC DSYEKKPPKEFLERFKSLLQKMIHQ HLSSRTHGSEDS | 2.09128725 | 2659 |
| IL-21_ 7516 | IL-21_ 4177 | H35I, N70G, N92G, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNGERIINVSI KKLKRKPPSDNPGRRQKHRLTCPSC DSYEKKPPKEFLERFKSLLQKMIHQ HLSSRTHGSEDS | 2.093814801 | 2660 |
| IL-21_ 14293 | IL-21_ 6318 | H35F, K81D, V98E, P107R | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKRKRPSTNAGRRQKHRLTCPSC DSYEKKPPKEFLERFKSLLQKMIHQ HLSSRTHGSEDS | 2.096793399 | 2661 |
| IL-21_ 15239 | IL-21_ 6018 | H35F, F76R, K81D, V98E, T110D | MRSSPGNMERIVICLMVIFLGTLVH KSSSQGQDRFMIRMRQLIDIVDQLK NYVNDLVPEFLPAPEDVETNCEWSA RSCFQDAQLKSANTGNNERIINESI KKLKRKPPSDNAGRRQKHRLTCPSC DSYEKKPPKEFLERFKSLLQKMIHQ HLSSRTHGSEDS | 2.099827872 | 2662 |
| IL-21_ 7223 | IL-21_ 4177 | H35I, N70G, P108M, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKRKPMSDNPGRRQKHRLTCPSC DSYEKKPPKEFLERFKSLLQKMIHQ HLSSRTHGSEDS | 2.103074525 | 2663 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 13048 | IL-21_ 6318 | H35F, R38K, K81D, V98E | MRSSPGNMERIVICLMVIFLGTLVH KSSSQGQDRFMIKMRQLIDIVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 2.103660646 | 2664 |
| IL-21_ 8477 | IL-21_ 4177 | H35I, R38W, N70G, T110D, A112P | MRSSPGNMERIVICLMVIFLGTLVH KSSSQGQDRIMIWMRQLIDIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.106163316 | 2665 |
| IL-21_ 7183 | IL-21_ 4177 | H35I, N70G, T110S, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKRKPPSSNPGRRQKHRLTCPSC DSYEKKPPKEFLERFKSLLQKMIHQ HLSSRTHGSEDS | 2.106485886 | 2666 |
| IL-21_ 12642 | IL-21_ 0910 | I45T, Q48K, K81D, V98E | MRSSPGNMERIVICLMVIFLGTLVH KSSSQGQDRHMIRMRQLIDTVDKLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 2.107292106 | 2667 |
| IL-21_ 10665 | IL-21_ 3610 | I37R, P107V, R114Q, R115D | MRSSPGNMERIVICLMVIFLGTLVH KSSSQGQDRHMRRMRQLIDIVDQLK NYVNDLVPEFLPAPEDVETNCEWSA FSCFQKAQLKSANTGNNERIINVSI KKLKRKVPSTNAGQDQKHRLTCPSC DSYEKKPPKEFLERFKSLLQKMIHQ HLSSRTHGSEDS | 2.108337686 | 2668 |
| IL-21_ 17561 | IL-21_ 5707 | R38K, K81D, V98E, P107V | MRSSPGNMERIVICLMVIFLGTLVH KSSSQGQDRHMIKMRQLIDIVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 2.109827531 | 2669 |
| IL-21_ 7489 | IL-21_ 4177 | H35I, N70G, E93S, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNSRIINVSI KKLKRKPPSDNPGRRQKHRLTCPSC DSYEKKPPKEFLERFKSLLQKMIHQ HLSSRTHGSEDS | 2.114136025 | 2670 |
| IL-21_ 7005 | IL-21_ 4177 | H35I, N70G, T110D, A112P, L120S | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKRKPPSDNPGRRQKHRSTCPSC DSYEKKPPKEFLERFKSLLQKMIHQ HLSSRTHGSEDS | 2.124936797 | 2671 |
| IL-21_ 7488 | IL-21_ 4177 | H35I, N70G, E93T, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNTRIINVSI KKLKRKPPSDNPGRRQKHRLTCPSC DSYEKKPPKEFLERFKSLLQKMIHQ HLSSRTHGSEDS | 2.125623049 | 2672 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 8500 | IL-21_ 4177 | H35I, I37Q, N70G, T110D, A112P | MRSSPGNMERIVICLMVIFLGTLVH KSSSQGQDRIMQRMRQLIDIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.125774336 | 2673 |
| IL-21_ 14253 | IL-21_ 6318 | H35F, K81D, V98E, R105L | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKLKPPSTNAGRRQKHRLTCPSC DSYEKKPPKEFLERFKSLLQKMIHQ HLSSRTHGSEDS | 2.12833226 | 2674 |
| IL-21_ 8166 | IL-21_ 4177 | H35I, L56F, N70G, T110D, A112P | MRSSPGNMERIVICLMVIFLGTLVH KSSSQGQDRIMIRMRQLIDIVDQLK NYVNDFVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.12921114 | 2675 |
| IL-21_ 7222 | IL-21_ 4177 | H35I, N70G, P108N, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKRKPNSDNPGRRQKHRLTCPSC DSYEKKPPKEFLERFKSLLQKMIHQ HLSSRTHGSEDS | 2.131265802 | 2676 |
| IL-21_ 16548 | IL-21_ 5845 | E65R, N70G, K81D | MRSSPGNMERIVICLMVIFLGTLVH KSSSQGQDRHMIRMRQLIDIVDQLK NYVNDLVPEFLPAPRDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.13367096 | 2677 |
| IL-21_ 8100 | IL-21_ 4177 | H35I, E59V, N70G, T110D, A112P | MRSSPGNMERIVICLMVIFLGTLVH KSSSQGQDRIMIRMRQLIDIVDQLK NYVNDLVPVELPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.134473328 | 2678 |
| IL-21_ 16170 | IL-21_ 5845 | D44Q, N70G, K81D | MRSSPGNMERIVICLMVIFLGTLVH KSSSQGQDRHMIRMRQLIQIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.134833056 | 2679 |
| IL-21_ 17350 | IL-21_ 5845 | N70G, K81D, T110H | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKRKPPSHNAGRRQKHRLTCPSC DSYEKKPPKEFLERFKSLLQKMIHQ HLSSRTHGSEDS | 2.135970401 | 2680 |
| IL-21_ 7619 | IL-21_ 4177 | H35I, N70G, S86M, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKMANTGNNERIINVSI KKLKRKPPSDNPGRRQKHRLTCPSC DSYEKKPPKEFLERFKSLLQKMIHQ HLSSRTHGSEDS | 2.140647089 | 2681 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 13041 | IL-21_ 6318 | H35F, R38A, K81D, V98E | MRSSPGNMERIVICLMVIFLGTLVHKSSSQGQDRFMIAMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 2.145496152 | 2682 |
| IL-21_ 16445 | IL-21_ 5845 | E59Y, N70G, K81D | MRSSPGNMERIVICLMVIFLGTLVHKSSSQGQDRHMIRMRQLIDIVDQLKNYVNDLVPYFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS | 2.145911428 | 2683 |
| IL-21_ 12707 | IL-21_ 0910 | D44S, I45T, K81D, V98E | MRSSPGNMERIVICLMVIFLGTLVHKSSSQGQDRHMIRMRQLISTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 2.146037087 | 2684 |
| IL-21_ 7187 | IL-21_ 4177 | H35I, N70G, T110N, A112P | MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSNNPGRRQKHRLTCPSCDSYEKKPPKEFLERFKSLLQKMIHQHLSSRTHGSEDS | 2.146632486 | 2685 |
| IL-21_ 16373 | IL-21_ 5845 | D55Y, N70G, K81D | MRSSPGNMERIVICLMVIFLGTLVHKSSSQGQDRHMIRMRQLIDIVDQLKNYVNYLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS | 2.148614987 | 2686 |
| IL-21_ 15604 | IL-21_ 6018 | H35F, K81D, I96Y, V98E, T110D | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIYNESIKKLKRKPPSDNAGRRQKHRLTCPSCDSYEKKPPKEFLERFKSLLQKMIHQHLSSRTHGSEDS | 2.148852592 | 2687 |
| IL-21_ 6576 | IL-21_ 4177 | H35I, N70G, T110D, A112P, L144M | MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLMQKMIHQHLSSRTHGSEDS | 2.150582557 | 2688 |
| IL-21_ 15979 | IL-21_ 5845 | D33W, N70G, K81D | MRSSPGNMERIVICLMVIFLGTLVHKSSSQGQWRHMIRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS | 2.152164842 | 2689 |
| IL-21_ 7686 | IL-21_ 4177 | H35I, N70G, A82T, T110D, A112P | MRSSPGNMERIVICLMVIFLGTLVHKSSSQGQDRIMIRMRQLIDIVDQLKNYVNDLVPEFLPAPEDVETGCEWSAFSCFQKTQLKSANTGNNERIINVSIKKLKRKPPSDNPGRRQKHRLTCPSCDSYEKKPPKEFLERFKSLLQKMIHQHLSSRTHGSEDS | 2.152273267 | 2690 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 16869 | IL-21_ 5845 | N70G, K81D, Q83K | MRSSPGNMERIVICLMVIFLGTLVH KSSSQGQDRHMIRMRQLIDIVDQLK NYVNDLVPEFLPAPEDVETGCEWSA FSCFQDAKLKSANTGNNERIINVSI KKLKRKPPSTNAGRRQKHRLTCPSC DSYEKKPPKEFLERFKSLLQKMIHQ HLSSRTHGSEDS | 2.154181035 | 2691 |
| IL-21_ 7736 | IL-21_ 4177 | H35I, N70G, Q80A, T110D, A112P | MRSSPGNMERIVICLMVIFLGTLVH KSSSQGQDRIMIRMRQLIDIVDQLK NYVNDLVPEFLPAPEDVETGCEWSA FSCFAKAQLKSANTGNNERIINVSI KKLKRKPPSDNPGRRQKHRLTCPSC DSYEKKPPKEFLERFKSLLQKMIHQ HLSSRTHGSEDS | 2.154817069 | 2692 |
| IL-21_ 17057 | IL-21_ 5845 | N70G, K81D, E93V | MRSSPGNMERIVICLMVIFLGTLVH KSSSQGQDRHMIRMRQLIDIVDQLK NYVNDLVPEFLPAPEDVETGCEWSA FSCFQDAQLKSANTGNNVRIINVSI KKLKRKPPSTNAGRRQKHRLTCPSC DSYEKKPPKEFLERFKSLLQKMIHQ HLSSRTHGSEDS | 2.157664249 | 2693 |
| IL-21_ 17227 | IL-21_ 5845 | N70G, K81D, L103I | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKIKRKPPSTNAGRRQKHRLTCPSC DSYEKKPPKEFLERFKSLLQKMIHQ HLSSRTHGSEDS | 2.16174098 | 2694 |
| IL-21_ 16307 | IL-21_ 5845 | Y52H, N70G, K81D | MRSSPGNMERIVICLMVIFLGTLVH KSSSQGQDRHMIRMRQLIDIVDQLK NHVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.165790853 | 2695 |
| IL-21_ 16993 | IL-21_ 5845 | N70G, K81D, G90I | MRSSPGNMERIVICLMVIFLGTLVH KSSSQGQDRHMIRMRQLIDIVDQLK NYVNDLVPEFLPAPEDVETGCEWSA FSCFQDAQLKSANTINNERIINVSI KKLKRKPPSTNAGRRQKHRLTCPSC DSYEKKPPKEFLERFKSLLQKMIHQ HLSSRTHGSEDS | 2.166075096 | 2696 |
| IL-21_ 13111 | IL-21_ 6318 | H35F, Q41W, K81D, V98E | MRSSPGNMERIVICLMVIFLGTLVH KSSSQGQDRFMIRMRWLIDIVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 2.166954881 | 2697 |
| IL-21_ 15757 | IL-21_ 6018 | H35F, K81D, V98E, R105M, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKMKPPSDNAGRRQKHRLTCPSC DSYEKKPPKEFLERFKSLLQKMIHQ HLSSRTHGSEDS | 2.167668321 | 2698 |
| IL-21_ 14167 | IL-21_ 6318 | H35F, K81D, V98E, I100R | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESR KKLKRKPPSTNAGRRQKHRLTCPSC DSYEKKPPKEFLERFKSLLQKMIHQ HLSSRTHGSEDS | 2.170126289 | 2699 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 16364 | IL-21_ 5845 | D55M, N70G, K81D | MRSSPGNMERIVICLMVIFLGTLVH KSSSQGQDRHMIRMRQLIDIVDQLK NYVNMLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.170458815 | 2700 |
| IL-21_ 16560 | IL-21_ 5845 | D66K, N70G, K81D | MRSSPGNMERIVICLMVIFLGTLVH KSSSQGQDRHMIRMRQLIDIVDQLK NYVNDLVPEFLPAPEKVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.17573168 | 2701 |
| IL-21_ 16821 | IL-21_ 5845 | N70G, Q80S, K81D | MRSSPGNMERIVICLMVIFLGTLVH KSSSQGQDRHMIRMRQLIDIVDQLK NYVNDLVPEFLPAPEDVETGCEWSA FSCFSDAQLKSANTGNNERIINVSI KKLKRKPPSTNAGRRQKHRLTCPSC DSYEKKPPKEFLERFKSLLQKMIHQ HLSSRTHGSEDS | 2.176321443 | 2702 |
| IL-21_ 16944 | IL-21_ 5845 | N70G, K81D, A87P | MRSSPGNMERIVICLMVIFLGTLVH KSSSQGQDRHMIRMRQLIDIVDQLK NYVNDLVPEFLPAPEDVETGCEWSA FSCFQDAQLKSPNTGNNERIINVSI KKLKRKPPSTNAGRRQKHRLTCPSC DSYEKKPPKEFLERFKSLLQKMIHQ HLSSRTHGSEDS | 2.17705247 | 2703 |
| IL-21_ 7150 | IL-21_ 4177 | H35I, N70G, T110D, A112R | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKRKPPSDNRGRRQKHRLTCPSC DSYEKKPPKEFLERFKSLLQKMIHQ HLSSRTHGSEDS | 2.180018661 | 2704 |
| IL-21_ 16027 | IL-21_ 5845 | M36R, N70G, K81D | MRSSPGNMERIVICLMVIFLGTLVH KSSSQGQDRHRIRMRQLIDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.180793616 | 2705 |
| IL-21_ 7503 | IL-21_ 4177 | H35I, N70G, N92Y, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNYERIINVSI KKLKRKPPSDNPGRRQKHRLTCPSC DSYEKKPPKEFLERFKSLLQKMIHQ HLSSRTHGSEDS | 2.181254 | 2706 |
| IL-21_ 14222 | IL-21_ 6318 | H35F, K81D, V98E, L103S | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKSKRKPPSTNAGRRQKHRLTCPSC DSYEKKPPKEFLERFKSLLQKMIHQ HLSSRTHGSEDS | 2.181308395 | 2707 |
| IL-21_ 7784 | IL-21_ 4177 | H35I, N70G, S77K, T110D, A112P | MRSSPGNMERIVICLMVIFLGTLVH KSSSQGQDRIMIRMRQLIDIVDQLK NYVNDLVPEFLPAPEDVETGCEWSA FKCFQKAQLKSANTGNNERIINVSI KKLKRKPPSDNPGRRQKHRLTCPSC DSYEKKPPKEFLERFKSLLQKMIHQ HLSSRTHGSEDS | 2.182220081 | 2708 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 9903 | IL-21_ 3610 | Q80A, P107V, R114Q, R115D | MRSSPGNMERIVICLMVIFLGTLVHKSSSQGQDRHMIRMRQLIDIVDQLKNYVNDLVPEFLPAPEDVETNCEWSAFSCFAKAQLKSANTGNNERIINVSIKKLKRKVPSTNAGQDQKHRLTCPSCDSYEKKPPKEFLERFKSLLQKMIHQHLSSRTHGSEDS | 2.183142292 | 2709 |
| IL-21_ 16593 | IL-21_ 5845 | E68G, N70G, K81D | MRSSPGNMERIVICLMVIFLGTLVHKSSSQGQDRHMIRMRQLIDIVDQLKNYVNDLVPEFLPAPEDVGTGCEWSAFSCFQDAQLKSANTGNNERIINVSIKKLKRKPPSTNAGRRQKHRLTCPSCDSYEKKPPKEFLERFKSLLQKMIHQHLSSRTHGSEDS | 2.186384581 | 2710 |
| IL-21_ 17318 | IL-21_ 5845 | N70G, K81D, P108L | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPLSTNAGRRQKHRLTCPSCDSYEKKPPKEFLERFKSLLQKMIHQHLSSRTHGSEDS | 2.186975479 | 2711 |
| IL-21_ 16677 | IL-21_ 5845 | N70G, E72T, K81D | MRSSPGNMERIVICLMVIFLGTLVHKSSSQGQDRHMIRMRQLIDIVDQLKNYVNDLVPEFLPAPEDVETGCTWSAFSCFQDAQLKSANTGNNERIINVSIKKLKRKPPSTNAGRRQKHRLTCPSCDSYEKKPPKEFLERFKSLLQKMIHQHLSSRTHGSEDS | 2.188118585 | 2712 |
| IL-21_ 7132 | IL-21_ 4177 | H35I, N70G, T110D, A112P, G113R | MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSDNPRRRQKHRLTCPSCDSYEKKPPKEFLERFKSLLQKMIHQHLSSRTHGSEDS | 2.188121687 | 2713 |
| IL-21_ 10671 | IL-21_ 3610 | I37K, P107V, R114Q, R115D | MRSSPGNMERIVICLMVIFLGTLVHKSSSQGQDRHMKRMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS | 2.19187472 | 2714 |
| IL-21_ 17280 | IL-21_ 5845 | N70G, K81D, K106H | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRHPPSTNAGRRQKHRLTCPSCDSYEKKPPKEFLERFKSLLQKMIHQHLSSRTHGSEDS | 2.19566728 | 2715 |
| IL-21_ 15978 | IL-21_ 5845 | D33V, N70G, K81D | MRSSPGNMERIVICLMVIFLGTLVHKSSSQGQVRHMIRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS | 2.196212518 | 2716 |
| IL-21_ 15977 | IL-21_ 5845 | D33T, N70G, K81D | MRSSPGNMERIVICLMVIFLGTLVHKSSSQGQTRHMIRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS | 2.19671623 | 2717 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 17327 | IL-21_ 5845 | N70G, K81D, P108Y | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKRKPYSTNAGRRQKHRLTCPSC DSYEKKPPKEFLERFKSLLQKMIHQ HLSSRTHGSEDS | 2.199634927 | 2718 |
| IL-21_ 11555 | IL-21_ 0910 | I45T, K81D, V98E, P108W | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KKLKRKPWSTNAGRRQKHRLTCPSC DSYEKKPPKEFLERFKSLLQKMIHQ HLSSRTHGSEDS | 2.199739522 | 2719 |
| IL-21_ 18643 | IL-21_ 5707 | K81D, V98P, P107V | MRSSPGNMERIVICLMVIFLGTLVH KSSSQGQDRHMIRMRQLIDIVDQLK NYVNDLVPEFLPAPEDVETNCEWSA FSCFQDAQLKSANTGNNERIINPSI KKLKRKVPSTNAGRRQKHRLTCPSC DSYEKKPPKEFLERFKSLLQKMIHQ HLSSRTHGSEDS | 2.203468362 | 2720 |
| IL-21_ 17055 | IL-21_ 5845 | N70G, K81D, E93S | MRSSPGNMERIVICLMVIFLGTLVH KSSSQGQDRHMIRMRQLIDIVDQLK NYVNDLVPEFLPAPEDVETGCEWSA FSCFQDAQLKSANTGNNSRIINVSI KKLKRKPPSTNAGRRQKHRLTCPSC DSYEKKPPKEFLERFKSLLQKMIHQ HLSSRTHGSEDS | 2.203715507 | 2721 |
| IL-21_ 18722 | IL-21_ 5707 | K81D, V98E, L103A, P107V | MRSSPGNMERIVICLMVIFLGTLVH KSSSQGQDRHMIRMRQLIDIVDQLK NYVNDLVPEFLPAPEDVETNCEWSA FSCFQDAQLKSANTGNNERIINESI KKAKRKVPSTNAGRRQKHRLTCPSC DSYEKKPPKEFLERFKSLLQKMIHQ HLSSRTHGSEDS | 2.204284899 | 2722 |
| IL-21_ 8214 | IL-21_ 4177 | H35I, V53M, N70G, T110D, A112P | MRSSPGNMERIVICLMVIFLGTLVH KSSSQGQDRIMIRMRQLIDIVDQLK NYMNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.206065275 | 2723 |
| IL-21_ 18801 | IL-21_ 5707 | K81D, V98E, P107K | MRSSPGNMERIVICLMVIFLGTLVH KSSSQGQDRHMIRMRQLIDIVDQLK NYVNDLVPEFLPAPEDVETNCEWSA FSCFQDAQLKSANTGNNERIINESI KKLKRKKPSTNAGRRQKHRLTCPSC DSYEKKPPKEFLERFKSLLQKMIHQ HLSSRTHGSEDS | 2.207023856 | 2724 |
| IL-21_ 16158 | IL-21_ 5845 | I43Y, N70G, K81D | MRSSPGNMERIVICLMVIFLGTLVH KSSSQGQDRHMIRMRQLYDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.207419577 | 2725 |
| IL-21_ 19866 | IL-21_ 5474 | N70G, K81D, A82Y, R114Q, R115D | MRSSPGNMERIVICLMVIFLGTLVH KSSSQGQDRHMIRMRQLIDIVDQLK NYVNDLVPEFLPAPEDVETGCEWSA FSCFQDYQLKSANTGNNERIINVSI KKLKRKPPSTNAGQDQKHRLTCPSC DSYEKKPPKEFLERFKSLLQKMIHQ HLSSRTHGSEDS | 2.21417666 | 2726 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 17040 | IL-21_ 5845 | N70G, K81D, N92W | MRSSPGNMERIVICLMVIFLGTLVH KSSSQGQDRHMIRMRQLIDIVDQLK NYVNDLVPEFLPAPEDVETGCEWSA FSCFQDAQLKSANTGNWERIINVSI KKLKRKPPSTNAGRRQKHRLTCPSC DSYEKKPPKEFLERFKSLLQKMIHQ HLSSRTHGSEDS | 2.216214166 | 2727 |
| IL-21_ 8374 | IL-21_ 4177 | H35I, D44Q, N70G, T110D, A112P | MRSSPGNMERIVICLMVIFLGTLVH KSSSQGQDRIMIRMRQLIQIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.217235225 | 2728 |
| IL-21_ 7726 | IL-21_ 4177 | H35I, N70G, Q80N, T110D, A112P | MRSSPGNMERIVICLMVIFLGTLVH KSSSQGQDRIMIRMRQLIDIVDQLK NYVNDLVPEFLPAPEDVETGCEWSA FSCENKAQLKSANTGNNERIINVSI KKLKRKPPSDNPGRRQKHRLTCPSC DSYEKKPPKEFLERFKSLLQKMIHQ HLSSRTHGSEDS | 2.222310266 | 2729 |
| IL-21_ 11677 | IL-21_ 0910 | I45T, K81D, V98E, K102D | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KDLKRKPPSTNAGRRQKHRLTCPSC DSYEKKPPKEFLERFKSLLQKMIHQ HLSSRTHGSEDS | 2.225320276 | 2730 |
| IL-21_ 16749 | IL-21_ 5845 | N70G, F76T, K81D | MRSSPGNMERIVICLMVIFLGTLVH KSSSQGQDRHMIRMRQLIDIVDQLK NYVNDLVPEFLPAPEDVETGCEWSA TSCFQDAQLKSANTGNNERIINVSI KKLKRKPPSTNAGRRQKHRLTCPSC DSYEKKPPKEFLERFKSLLQKMIHQ HLSSRTHGSEDS | 2.226508641 | 2731 |
| IL-21_ 16839 | IL-21_ 5845 | N70G, K81S | MRSSPGNMERIVICLMVIFLGTLVH KSSSQGQDRHMIRMRQLIDIVDQLK NYVNDLVPEFLPAPEDVETGCEWSA FSCFQSAQLKSANTGNNERIINVSI KKLKRKPPSTNAGRRQKHRLTCPSC DSYEKKPPKEFLERFKSLLQKMIHQ HLSSRTHGSEDS | 2.227481614 | 2732 |
| IL-21_ 7778 | IL-21_ 4177 | H35I, N70G, S77R, T110D, A112P | MRSSPGNMERIVICLMVIFLGTLVH KSSSQGQDRIMIRMRQLIDIVDQLK NYVNDLVPEFLPAPEDVETGCEWSA FRCFQKAQLKSANTGNNERIINVSI KKLKRKPPSDNPGRRQKHRLTCPSC DSYEKKPPKEFLERFKSLLQKMIHQ HLSSRTHGSEDS | 2.227514134 | 2733 |
| IL-21_ 7246 | IL-21_ 4177 | H35I, N70G, P107G, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKRKGPSDNPGRRQKHRLTCPSC DSYEKKPPKEFLERFKSLLQKMIHQ HLSSRTHGSEDS | 2.232032473 | 2734 |
| IL-21_ 18767 | IL-21_ 5707 | K81D, V98E, R105M, P107V | MRSSPGNMERIVICLMVIFLGTLVH KSSSQGQDRHMIRMRQLIDIVDQLK NYVNDLVPEFLPAPEDVETNCEWSA FSCFQDAQLKSANTGNNERIINESI KKLKMKVPSTNAGRRQKHRLTCPSC DSYEKKPPKEFLERFKSLLQKMIHQ HLSSRTHGSEDS | 2.239973514 | 2735 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 8370 | IL-21_ 4177 | H35I, D44V, N70G, T110D, A112P | MRSSPGNMERIVICLMVIFLGTLVH KSSSQGQDRIMIRMRQLIVIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.240313095 | 2736 |
| IL-21_ 7775 | IL-21_ 4177 | H35I, N70G, S77W, T110D, A112P | MRSSPGNMERIVICLMVIFLGTLVH KSSSQGQDRIMIRMRQLIDIVDQLK NYVNDLVPEFLPAPEDVETGCEWSA FWCFQKAQLKSANTGNNERIINVSI KKLKRKPPSDNPGRRQKHRLTCPSC DSYEKKPPKEFLERFKSLLQKMIHQ HLSSRTHGSEDS | 2.247636884 | 2737 |
| IL-21_ 7390 | IL-21_ 4177 | H35I, N70G, S99G, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVGI KKLKRKPPSDNPGRRQKHRLTCPSC DSYEKKPPKEFLERFKSLLQKMIHQ HLSSRTHGSEDS | 2.247907431 | 2738 |
| IL-21_ 20186 | IL-21_ 5474 | N70G, K81D, I100S, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSS KKLKRKPPSTNAGQDQKHRLTCPSC DSYEKKPPKEFLERFKSLLQKMIHQ HLSSRTHGSEDS | 2.24868668 | 2739 |
| IL-21_ 11663 | IL-21_ 0910 | I45T, K81D, V98E, K102V | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KVLKRKPPSTNAGRRQKHRLTCPSC DSYEKKPPKEFLERFKSLLQKMIHQ HLSSRTHGSEDS | 2.24889862 | 2740 |
| IL-21_ 16964 | IL-21_ 5845 | N70G, K81D, N88R | MRSSPGNMERIVICLMVIFLGTLVH KSSSQGQDRHMIRMRQLIDIVDQLK NYVNDLVPEFLPAPEDVETGCEWSA FSCFQDAQLKSARTGNNERIINVSI KKLKRKPPSTNAGRRQKHRLTCPSC DSYEKKPPKEFLERFKSLLQKMIHQ HLSSRTHGSEDS | 2.249882244 | 2741 |
| IL-21_ 8509 | IL-21_ 4177 | H35I, I37E, N70G, T110D, A112P | MRSSPGNMERIVICLMVIFLGTLVH KSSSQGQDRIMERMRQLIDIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.252733497 | 2742 |
| IL-21_ 16706 | IL-21_ 5845 | N70G, S74K, K81D | MRSSPGNMERIVICLMVIFLGTLVH KSSSQGQDRHMIRMRQLIDIVDQLK NYVNDLVPEFLPAPEDVETGCEWKA FSCFQDAQLKSANTGNNERIINVSI KKLKRKPPSTNAGRRQKHRLTCPSC DSYEKKPPKEFLERFKSLLQKMIHQ HLSSRTHGSEDS | 2.257488828 | 2743 |
| IL-21_ 7409 | IL-21_ 4177 | H35I, N70G, V98F, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINESI KKLKRKPPSDNPGRRQKHRLTCPSC DSYEKKPPKEFLERFKSLLQKMIHQ HLSSRTHGSEDS | 2.258091769 | 2744 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 17047 | IL-21_ 5845 | N70G, K81D, E93I | MRSSPGNMERIVICLMVIFLGTLVH KSSSQGQDRHMIRMRQLIDIVDQLK NYVNDLVPEFLPAPEDVETGCEWSA FSCFQDAQLKSANTGNNIRIIINVSI KKLKRKPPSTNAGRRQKHRLTCPSC DSYEKKPPKEFLERFKSLLQKMIHQ HLSSRTHGSEDS | 2.25934197 | 2745 |
| IL-21_ 16867 | IL-21_ 5845 | N70G, K81D, Q83H | MRSSPGNMERIVICLMVIFLGTLVH KSSSQGQDRHMIRMRQLIDIVDQLK NYVNDLVPEFLPAPEDVETGCEWSA FSCFQDAHLKSANTGNNERIIINVSI KKLKRKPPSTNAGRRQKHRLTCPSC DSYEKKPPKEFLERFKSLLQKMIHQ HLSSRTHGSEDS | 2.261753111 | 2746 |
| IL-21_ 14095 | IL-21_ 6318 | H35F, K81D, I96Q, V98E | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIQNESI KKLKRKPPSTNAGRRQKHRLTCPSC DSYEKKPPKEFLERFKSLLQKMIHQ HLSSRTHGSEDS | 2.261999435 | 2747 |
| IL-21_ 15589 | IL-21_ 6018 | H35F, K81D, I96E, V98E, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIENESI KKLKRKPPSDNAGRRQKHRLTCPSC DSYEKKPPKEFLERFKSLLQKMIHQ HLSSRTHGSEDS | 2.264466711 | 2748 |
| IL-21_ 17082 | IL-21_ 5845 | N70G, K81D, I95G | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERGINVSI KKLKRKPPSTNAGRRQKHRLTCPSC DSYEKKPPKEFLERFKSLLQKMIHQ HLSSRTHGSEDS | 2.265171147 | 2749 |
| IL-21_ 8495 | IL-21_ 4177 | H35I, I37W, N70G, T110D, A112P | MRSSPGNMERIVICLMVIFLGTLVH KSSSQGQDRIMWRMRQLIDIVDQLK NYVNDLVPEFLPAPEDVETGCEWSA FSCFQKAQLKSANTGNNERIIINVSI KKLKRKPPSDNPGRRQKHRLTCPSC DSYEKKPPKEFLERFKSLLQKMIHQ HLSSRTHGSEDS | 2.275441678 | 2750 |
| IL-21_ 18637 | IL-21_ 5707 | K81D, V98H, P107V | MRSSPGNMERIVICLMVIFLGTLVH KSSSQGQDRHMIRMRQLIDIVDQLK NYVNDLVPEFLPAPEDVETNCEWSA FSCFQDAQLKSANTGNNERIINHSI KKLKRKVPSTNAGRRQKHRLTCPSC DSYEKKPPKEFLERFKSLLQKMIHQ HLSSRTHGSEDS | 2.282310747 | 2751 |
| IL-21_ 16580 | IL-21_ 5845 | V67L, N70G, K81D | MRSSPGNMERIVICLMVIFLGTLVH KSSSQGQDRHMIRMRQLIDIVDQLK NYVNDLVPEFLPAPEDLETGCEWSA FSCFQDAQLKSANTGNNERIIINVSI KKLKRKPPSTNAGRRQKHRLTCPSC DSYEKKPPKEFLERFKSLLQKMIHQ HLSSRTHGSEDS | 2.287553091 | 2752 |
| IL-21_ 16688 | IL-21_ 5845 | N70G, W73K, K81D | MRSSPGNMERIVICLMVIFLGTLVH KSSSQGQDRHMIRMRQLIDIVDQLK NYVNDLVPEFLPAPEDVETGCEKSA FSCFQDAQLKSANTGNNERIIINVSI KKLKRKPPSTNAGRRQKHRLTCPSC DSYEKKPPKEFLERFKSLLQKMIHQ HLSSRTHGSEDS | 2.290443184 | 2753 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 16144 | IL-21_ 5845 | I43F, N70G, K81D | MRSSPGNMERIVICLMVIFLGTLVH KSSSQGQDRHMIRMRQLFDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.290724331 | 2754 |
| IL-21_ 17298 | IL-21_ 5845 | N70G, K81D, P107H | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKRKHPSTNAGRRQKHRLTCPSC DSYEKKPPKEFLERFKSLLQKMIHQ HLSSRTHGSEDS | 2.297622558 | 2755 |
| IL-21_ 16636 | IL-21_ 5845 | N70P, K81D | MRSSPGNMERIVICLMVIFLGTLVH KSSSQGQDRHMIRMRQLIDIVDQLK NYVNDLVPEFLPAPEDVETPCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.297793725 | 2756 |
| IL-21_ 16834 | IL-21_ 5845 | N70G, K81M | MRSSPGNMERIVICLMVIFLGTLVH KSSSQGQDRHMIRMRQLIDIVDQLK NYVNDLVPEFLPAPEDVETGCEWSA FSCFQMAQLKSANTGNNERIINVSI KKLKRKPPSTNAGRRQKHRLTCPSC DSYEKKPPKEFLERFKSLLQKMIHQ HLSSRTHGSEDS | 2.299317227 | 2757 |
| IL-21_ 19394 | IL-21_ 5474 | L56S, N70G, K81D, R114Q, R115D | MRSSPGNMERIVICLMVIFLGTLVH KSSSQGQDRHMIRMRQLIDIVDQLK NYVNDSVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 2.299498227 | 2758 |
| IL-21_ 9574 | IL-21_ 3610 | V98K, P107V, R114Q, R115D | MRSSPGNMERIVICLMVIFLGTLVH KSSSQGQDRHMIRMRQLIDIVDQLK NYVNDLVPEFLPAPEDVETNCEWSA FSCFQKAQLKSANTGNNERIINKSI KKLKRKVPSTNAGQDQKHRLTCPSC DSYEKKPPKEFLERFKSLLQKMIHQ HLSSRTHGSEDS | 2.300233633 | 2759 |
| IL-21_ 17059 | IL-21_ 5845 | N70G, K81D, E93Y | MRSSPGNMERIVICLMVIFLGTLVH KSSSQGQDRHMIRMRQLIDIVDQLK NYVNDLVPEFLPAPEDVETGCEWSA FSCFQDAQLKSANTGNNYRIINVSI KKLKRKPPSTNAGRRQKHRLTCPSC DSYEKKPPKEFLERFKSLLQKMIHQ HLSSRTHGSEDS | 2.305812291 | 2760 |
| IL-21_ 8498 | IL-21_ 4177 | H35I, I37S, N70G, T110D, A112P | MRSSPGNMERIVICLMVIFLGTLVH KSSSQGQDRIMSRMRQLIDIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.306153022 | 2761 |
| IL-21_ 8510 | IL-21_ 4177 | H35I, I37D, N70G, T110D, A112P | MRSSPGNMERIVICLMVIFLGTLVH KSSSQGQDRIMDRMRQLIDIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.306508948 | 2762 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 16810 | IL-21_ 5845 | N70G, Q80E, K81D | MRSSPGNMERIVICLMVIFLGTLVH KSSSQGQDRHMIRMRQLIDIVDQLK NYVNDLVPEFLPAPEDVETGCEWSA FSCFEDAQLKSANTGNNERIINVSI KKLKRKPPSTNAGRRQKHRLTCPSC DSYEKKPPKEFLERFKSLLQKMIHQ HLSSRTHGSEDS | 2.306872497 | 2763 |
| IL-21_ 14570 | IL-21_ 6018 | H35F, M39P, K81D, V98E, T110D | MRSSPGNMERIVICLMVIFLGTLVH KSSSQGQDRFMIRPRQLIDIVDQLK NYVNDLVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 2.307418786 | 2764 |
| IL-21_ 17056 | IL-21_ 5845 | N70G, K81D, E93T | MRSSPGNMERIVICLMVIFLGTLVH KSSSQGQDRHMIRMRQLIDIVDQLK NYVNDLVPEFLPAPEDVETGCEWSA FSCFQDAQLKSANTGNNTRIINVSI KKLKRKPPSTNAGRRQKHRLTCPSC DSYEKKPPKEFLERFKSLLQKMIHQ HLSSRTHGSEDS | 2.310064986 | 2765 |
| IL-21_ 9452 | IL-21_ 3610 | R105F, P107V, R114Q, R115D | MRSSPGNMERIVICLMVIFLGTLVH KSSSQGQDRHMIRMRQLIDIVDQLK NYVNDLVPEFLPAPEDVETNCEWSA FSCFQKAQLKSANTGNNERIINVSI KKLKFKVPSTNAGQDQKHRLTCPSC DSYEKKPPKEFLERFKSLLQKMIHQ HLSSRTHGSEDS | 2.315304129 | 2766 |
| IL-21_ 8385 | IL-21_ 4177 | H35I, D44A, N70G, T110D, A112P | MRSSPGNMERIVICLMVIFLGTLVH KSSSQGQDRIMIRMRQLIAIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.317688487 | 2767 |
| IL-21_ 19199 | IL-21_ 5474 | I45W, N70G, K81D, R114Q, R115D | MRSSPGNMERIVICLMVIFLGTLVH KSSSQGQDRHMIRMRQLIDWVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 2.321466573 | 2768 |
| IL-21_ 7233 | IL-21_ 4177 | H35I, N70G, P107Y, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKRKYPSDNPGRRQKHRLTCPSC DSYEKKPPKEFLERFKSLLQKMIHQ HLSSRTHGSEDS | 2.33530255 | 2769 |
| IL-21_ 17387 | IL-21_ 5845 | N70G, K81D, A112K | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKRKPPSTNKGRRQKHRLTCPSC DSYEKKPPKEFLERFKSLLQKMIHQ HLSSRTHGSEDS | 2.342215031 | 2770 |
| IL-21_ 7730 | IL-21_ 4177 | H35I, N70G, Q80I, T110D, A112P | MRSSPGNMERIVICLMVIFLGTLVH KSSSQGQDRIMIRMRQLIDIVDQLK NYVNDLVPEFLPAPEDVETGCEWSA FSCFIKAQLKSANTGNNERIINVSI KKLKRKPPSDNPGRRQKHRLTCPSC DSYEKKPPKEFLERFKSLLQKMIHQ HLSSRTHGSEDS | 2.342806878 | 2771 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 16190 | IL-21_ 5845 | I45S, N70G, K81D | MRSSPGNMERIVICLMVIFLGTLVH KSSSQGQDRHMIRMRQLIDSVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.359326608 | 2772 |
| IL-21_ 16237 | IL-21_ 5845 | Q48K, N70G, K81D | MRSSPGNMERIVICLMVIFLGTLVH KSSSQGQDRHMIRMRQLIDIVDKLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.364697651 | 2773 |
| IL-21_ 16994 | IL-21_ 5845 | N70G, K81D, G90K | MRSSPGNMERIVICLMVIFLGTLVH KSSSQGQDRHMIRMRQLIDIVDQLK NYVNDLVPEFLPAPEDVETGCEWSA FSCFQDAQLKSANTKNNERIINVSI KKLKRKPPSTNAGRRQKHRLTCPSC DSYEKKPPKEFLERFKSLLQKMIHQ HLSSRTHGSEDS | 2.367834744 | 2774 |
| IL-21_ 16172 | IL-21_ 5845 | D44S, N70G, K81D | MRSSPGNMERIVICLMVIFLGTLVH KSSSQGQDRHMIRMRQLISIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.368609322 | 2775 |
| IL-21_ 16818 | IL-21_ 5845 | N70G, Q80N, K81D | MRSSPGNMERIVICLMVIFLGTLVH KSSSQGQDRHMIRMRQLIDIVDQLK NYVNDLVPEFLPAPEDVETGCEWSA FSCENDAQLKSANTGNNERIINVSI KKLKRKPPSTNAGRRQKHRLTCPSC DSYEKKPPKEFLERFKSLLQKMIHQ HLSSRTHGSEDS | 2.369055148 | 2776 |
| IL-21_ 18765 | IL-21_ 5707 | K81D, V98E, R105K, P107V | MRSSPGNMERIVICLMVIFLGTLVH KSSSQGQDRHMIRMRQLIDIVDQLK NYVNDLVPEFLPAPEDVETNCEWSA FSCFQDAQLKSANTGNNERIINESI KKLKKKVPSTNAGRRQKHRLTCPSC DSYEKKPPKEFLERFKSLLQKMIHQ HLSSRTHGSEDS | 2.36927041 | 2777 |
| IL-21_ 8371 | IL-21_ 4177 | H35I, D44T, N70G, T110D, A112P | MRSSPGNMERIVICLMVIFLGTLVH KSSSQGQDRIMIRMRQLITIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.373662246 | 2778 |
| IL-21_ 8377 | IL-21_ 4177 | H35I, D44M, N70G, T110D, A112P | MRSSPGNMERIVICLMVIFLGTLVH KSSSQGQDRIMIRMRQLIMIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.374863099 | 2779 |
| IL-21_ 7278 | IL-21_ 4177 | H35I, N70G, R105L, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKLKPPSDNPGRRQKHRLTCPSC DSYEKKPPKEFLERFKSLLQKMIHQ HLSSRTHGSEDS | 2.377081002 | 2780 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 13120 | IL-21_ 6318 | H35F, L42K, K81D, V98E | MRSSPGNMERIVICLMVIFLGTLVHKSSSQGQDRFMIRMRQKIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 2.380046617 | 2781 |
| IL-21_ 17310 | IL-21_ 5845 | N70G, K81D, P108A | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPASTNAGRRQKHRLTCPSCDSYEKKPPKEFLERFKSLLQKMIHQHLSSRTHGSEDS | 2.383847033 | 2782 |
| IL-21_ 7215 | IL-21_ 4177 | H35I, N70G, P108Y, T110D, A112P | MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPYSDNPGRRQKHRLTCPSCDSYEKKPPKEFLERFKSLLQKMIHQHLSSRTHGSEDS | 2.393109747 | 2783 |
| IL-21_ 16490 | IL-21_ 5845 | P62L, N70G, K81D | MRSSPGNMERIVICLMVIFLGTLVHKSSSQGQDRHMIRMRQLIDIVDQLKNYVNDLVPEFLLAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS | 2.393606458 | 2784 |
| IL-21_ 16828 | IL-21_ 5845 | N70G, K81F | MRSSPGNMERIVICLMVIFLGTLVHKSSSQGQDRHMIRMRQLIDIVDQLKNYVNDLVPEFLPAPEDVETGCEWSAFSCFQFAQLKSANTGNNERIINVSIKKLKRKPPSTNAGRRQKHRLTCPSCDSYEKKPPKEFLERFKSLLQKMIHQHLSSRTHGSEDS | 2.397737741 | 2785 |
| IL-21_ 16036 | IL-21_ 5845 | I37F, N70G, K81D | MRSSPGNMERIVICLMVIFLGTLVHKSSSQGQDRHMFRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS | 2.402782204 | 2786 |
| IL-21_ 7571 | IL-21_ 4177 | H35I, N70G, T89F, T110D, A112P | MRSSPGNMERIVICLMVIFLGTLVHKSSSQGQDRIMIRMRQLIDIVDQLKNYVNDLVPEFLPAPEDVETGCEWSAFSCFQKAQLKSANFGNNERIINVSIKKLKRKPPSDNPGRRQKHRLTCPSCDSYEKKPPKEFLERFKSLLQKMIHQHLSSRTHGSEDS | 2.405329419 | 2787 |
| IL-21_ 12894 | IL-21_ 0910 | R34G, I45T, K81D, V98E | MRSSPGNMERIVICLMVIFLGTLVHKSSSQGQDGHMIRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 2.408168989 | 2788 |
| IL-21_ 14132 | IL-21_ 6318 | H35F, K81D, V98R | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINRSIKKLKRKPPSTNAGRRQKHRLTCPSCDSYEKKPPKEFLERFKSLLQKMIHQHLSSRTHGSEDS | 2.409372926 | 2789 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 16826 | IL-21_ 5845 | N70G, K81A | MRSSPGNMERIVICLMVIFLGTLVH KSSSQGQDRHMIRMRQLIDIVDQLK NYVNDLVPEFLPAPEDVETGCEWSA FSCFQAAQLKSANTGNNERIINVSI KKLKRKPPSTNAGRRQKHRLTCPSC DSYEKKPPKEFLERFKSLLQKMIHQ HLSSRTHGSEDS | 2.410763539 | 2790 |
| IL-21_ 8231 | IL-21_ 4177 | H35I, Y52N, N70G, T110D, A112P | MRSSPGNMERIVICLMVIFLGTLVH KSSSQGQDRIMIRMRQLIDIVDQLK NNVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.410794614 | 2791 |
| IL-21_ 15600 | IL-21_ 6018 | H35F, K81D, I96S, V98E, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERISNESI KKLKRKPPSDNAGRRQKHRLTCPSC DSYEKKPPKEFLERFKSLLQKMIHQ HLSSRTHGSEDS | 2.417786418 | 2792 |
| IL-21_ 16054 | IL-21_ 5845 | R38F, N70G, K81D | MRSSPGNMERIVICLMVIFLGTLVH KSSSQGQDRHMIFMRQLIDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.423028688 | 2793 |
| IL-21_ 16808 | IL-21_ 5845 | N70G, Q80A, K81D | MRSSPGNMERIVICLMVIFLGTLVH KSSSQGQDRHMIRMRQLIDIVDQLK NYVNDLVPEFLPAPEDVETGCEWSA FSCFADAQLKSANTGNNERIINVSI KKLKRKPPSTNAGRRQKHRLTCPSC DSYEKKPPKEFLERFKSLLQKMIHQ HLSSRTHGSEDS | 2.426454524 | 2794 |
| IL-21_ 16168 | IL-21_ 5845 | D44N, N70G, K81D | MRSSPGNMERIVICLMVIFLGTLVH KSSSQGQDRHMIRMRQLINIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.430205336 | 2795 |
| IL-21_ 17392 | IL-21_ 5845 | N70G, K81D, A112R | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKRKPPSTNRGRRQKHRLTCPSC DSYEKKPPKEFLERFKSLLQKMIHQ HLSSRTHGSEDS | 2.430823477 | 2796 |
| IL-21_ 7192 | IL-21_ 4177 | H35I, N70G, T110H, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKRKPPSHNPGRRQKHRLTCPSC DSYEKKPPKEFLERFKSLLQKMIHQ HLSSRTHGSEDS | 2.436120113 | 2797 |
| IL-21_ 15659 | IL-21_ 6018 | H35F, K81D, V98E, I100D, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESD KKLKRKPPSDNAGRRQKHRLTCPSC DSYEKKPPKEFLERFKSLLQKMIHQ HLSSRTHGSEDS | 2.438378799 | 2798 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 17119 | IL-21_ 5845 | N70G, K81D, N97H | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIIHVSI KKLKRKPPSTNAGRRQKHRLTCPSC DSYEKKPPKEFLERFKSLLQKMIHQ HLSSRTHGSEDS | 2.439139595 | 2799 |
| IL-21_ 17410 | IL-21_ 5845 | N70G, K81D, G113R | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKRKPPSTNARRRQKHRLTCPSC DSYEKKPPKEFLERFKSLLQKMIHQ HLSSRTHGSEDS | 2.446263937 | 2800 |
| IL-21_ 8562 | IL-21_ 4177 | R34D, H35I, N70G, T110D, A112P | MRSSPGNMERIVICLMVIFLGTLVH KSSSQGQDDIMIRMRQLIDIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.453555415 | 2801 |
| IL-21_ 15982 | IL-21_ 5845 | R34D, N70G, K81D | MRSSPGNMERIVICLMVIFLGTLVH KSSSQGQDDHMIRMRQLIDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.455208785 | 2802 |
| IL-21_ 17288 | IL-21_ 5845 | N70G, K81D, K106S | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKRSPPSTNAGRRQKHRLTCPSC DSYEKKPPKEFLERFKSLLQKMIHQ HLSSRTHGSEDS | 2.455399497 | 2803 |
| IL-21_ 16634 | IL-21_ 5845 | N70M, K81D | MRSSPGNMERIVICLMVIFLGTLVH KSSSQGQDRHMIRMRQLIDIVDQLK NYVNDLVPEFLPAPEDVETMCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.455531491 | 2804 |
| IL-21_ 7269 | IL-21_ 4177 | H35I, N70G, R105Y, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKYKPPSDNPGRRQKHRLTCPSC DSYEKKPPKEFLERFKSLLQKMIHQ HLSSRTHGSEDS | 2.458407793 | 2805 |
| IL-21_ 7245 | IL-21_ 4177 | H35I, N70G, P107H, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKRKHPSDNPGRRQKHRLTCPSC DSYEKKPPKEFLERFKSLLQKMIHQ HLSSRTHGSEDS | 2.461225856 | 2806 |
| IL-21_ 7551 | IL-21_ 4177 | H35I, N70G, G90I, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTINNERIINVSI KKLKRKPPSDNPGRRQKHRLTCPSC DSYEKKPPKEFLERFKSLLQKMIHQ HLSSRTHGSEDS | 2.464806401 | 2807 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 7504 | IL-21_ 4177 | H35I, N70G, N92W, T110D, A112P | MRSSPGNMERIVICLMVIFLGTLVHKSSSQGQDRIMIRMRQLIDIVDQLKNYVNDLVPEFLPAPEDVETGCEWSAFSCFQKAQLKSANTGNWERIINVSIKKLKRKPPSDNPGRRQKHRLTCPSCDSYEKKPPKEFLERFKSLLQKMIHQHLSSRTHGSEDS | 2.466687841 | 2808 |
| IL-21_ 16823 | IL-21_ 5845 | N70G, Q80V, K81D | MRSSPGNMERIVICLMVIFLGTLVHKSSSQGQDRHMIRMRQLIDIVDQLKNYVNDLVPEFLPAPEDVETGCEWSAFSCFVDAQLKSANTGNNERIINVSIKKLKRKPPSTNAGRRQKHRLTCPSCDSYEKKPPKEFLERFKSLLQKMIHQHLSSRTHGSEDS | 2.468097472 | 2809 |
| IL-21_ 19064 | IL-21_ 5474 | R38K, N70G, K81D, R114Q, R115D | MRSSPGNMERIVICLMVIFLGTLVHKSSSQGQDRHMIKMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS | 2.494937637 | 2810 |
| IL-21_ 16831 | IL-21_ 5845 | N70G, K81I | MRSSPGNMERIVICLMVIFLGTLVHKSSSQGQDRHMIRMRQLIDIVDQLKNYVNDLVPEFLPAPEDVETGCEWSAFSCFQIAQLKSANTGNNERIINVSIKKLKRKPPSTNAGRRQKHRLTCPSCDSYEKKPPKEFLERFKSLLQKMIHQHLSSRTHGSEDS | 2.498848827 | 2811 |
| IL-21_ 16837 | IL-21_ 5845 | N70G, K81Q | MRSSPGNMERIVICLMVIFLGTLVHKSSSQGQDRHMIRMRQLIDIVDQLKNYVNDLVPEFLPAPEDVETGCEWSAFSCFQQAQLKSANTGNNERIINVSIKKLKRKPPSTNAGRRQKHRLTCPSCDSYEKKPPKEFLERFKSLLQKMIHQHLSSRTHGSEDS | 2.503972333 | 2812 |
| IL-21_ 10655 | IL-21_ 3610 | R38G, P107V, R114Q, R115D | MRSSPGNMERIVICLMVIFLGTLVHKSSSQGQDRHMIGMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS | 2.508054904 | 2813 |
| IL-21_ 16025 | IL-21_ 5845 | M36P, N70G, K81D | MRSSPGNMERIVICLMVIFLGTLVHKSSSQGQDRHPIRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS | 2.511104582 | 2814 |
| IL-21_ 16043 | IL-21_ 5845 | I37P, N70G, K81D | MRSSPGNMERIVICLMVIFLGTLVHKSSSQGQDRHMPRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS | 2.514942085 | 2815 |
| IL-21_ 14608 | IL-21_ 6018 | H35F, Q41R, K81D, V98E, T110D | MRSSPGNMERIVICLMVIFLGTLVHKSSSQGQDRFMIRMRRLIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS | 2.522553903 | 2816 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 7216 | IL-21_ 4177 | H35I, N70G, P108W, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKRKPWSDNPGRRQKHRLTCPSC DSYEKKPPKEFLERFKSLLQKMIHQ HLSSRTHGSEDS | 2.527628663 | 2817 |
| IL-21_ 16859 | IL-21_ 5845 | N70G, K81D, A82V | MRSSPGNMERIVICLMVIFLGTLVH KSSSQGQDRHMIRMRQLIDIVDQLK NYVNDLVPEFLPAPEDVETGCEWSA FSCFQDVQLKSANTGNNERIINVSI KKLKRKPPSTNAGRRQKHRLTCPSC DSYEKKPPKEFLERFKSLLQKMIHQ HLSSRTHGSEDS | 2.536062332 | 2818 |
| IL-21_ 12704 | IL-21_ 0910 | D44W, I45T, K81D, V98E | MRSSPGNMERIVICLMVIFLGTLVH KSSSQGQDRHMIRMRQLIWTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 2.547481059 | 2819 |
| IL-21_ 16712 | IL-21_ 5845 | N70G, S74R, K81D | MRSSPGNMERIVICLMVIFLGTLVH KSSSQGQDRHMIRMRQLIDIVDQLK NYVNDLVPEFLPAPEDVETGCEWRA FSCFQDAQLKSANTGNNERIINVSI KKLKRKPPSTNAGRRQKHRLTCPSC DSYEKKPPKEFLERFKSLLQKMIHQ HLSSRTHGSEDS | 2.549119856 | 2820 |
| IL-21_ 7734 | IL-21_ 4177 | H35I, N70G, Q80E, T110D, A112P | MRSSPGNMERIVICLMVIFLGTLVH KSSSQGQDRIMIRMRQLIDIVDQLK NYVNDLVPEFLPAPEDVETGCEWSA FSCFEKAQLKSANTGNNERIINVSI KKLKRKPPSDNPGRRQKHRLTCPSC DSYEKKPPKEFLERFKSLLQKMIHQ HLSSRTHGSEDS | 2.551501777 | 2821 |
| IL-21_ 17314 | IL-21_ 5845 | N70G, K81D, P108G | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKRKPGSTNAGRRQKHRLTCPSC DSYEKKPPKEFLERFKSLLQKMIHQ HLSSRTHGSEDS | 2.555177259 | 2822 |
| IL-21_ 7414 | IL-21_ 4177 | H35I, N70G, N97W, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIIWVSI KKLKRKPPSDNPGRRQKHRLTCPSC DSYEKKPPKEFLERFKSLLQKMIHQ HLSSRTHGSEDS | 2.557491354 | 2823 |
| IL-21_ 7510 | IL-21_ 4177 | H35I, N70G, N92P, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNPERIINVSI KKLKRKPPSDNPGRRQKHRLTCPSC DSYEKKPPKEFLERFKSLLQKMIHQ HLSSRTHGSEDS | 2.571758009 | 2824 |
| IL-21_ 16215 | IL-21_ 5845 | D47G, N70G, K81D | MRSSPGNMERIVICLMVIFLGTLVH KSSSQGQDRHMIRMRQLIDIVGQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.572226303 | 2825 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 16675 | IL-21_ 5845 | N70G, E72R, K81D | MRSSPGNMERIVICLMVIFLGTLVHKSSSQGQDRHMIRMRQLIDIVDQLKNYVNDLVPEFLPAPEDVETGCRWSAFSCFQDAQLKSANTGNNERIINVSIKKLKRKPPSTNAGRRQKHRLTCPSCDSYEKKPPKEFLERFKSLLQKMIHQHLSSRTHGSEDS | 2.572493085 | 2826 |
| IL-21_ 8378 | IL-21_ 4177 | H35I, D44L, N70G, T110D, A112P | MRSSPGNMERIVICLMVIFLGTLVHKSSSQGQDRIMIRMRQLILIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS | 2.582368969 | 2827 |
| IL-21_ 7727 | IL-21_ 4177 | H35I, N70G, Q80M, T110D, A112P | MRSSPGNMERIVICLMVIFLGTLVHKSSSQGQDRIMIRMRQLIDIVDQLKNYVNDLVPEFLPAPEDVETGCEWSAFSCFMKAQLKSANTGNNERIINVSIKKLKRKPPSDNPGRRQKHRLTCPSCDSYEKKPPKEFLERFKSLLQKMIHQHLSSRTHGSEDS | 2.591617882 | 2828 |
| IL-21_ 16877 | IL-21_ 5845 | N70G, K81D, Q83V | MRSSPGNMERIVICLMVIFLGTLVHKSSSQGQDRHMIRMRQLIDIVDQLKNYVNDLVPEFLPAPEDVETGCEWSAFSCFQDAVLKSANTGNNERIINVSIKKLKRKPPSTNAGRRQKHRLTCPSCDSYEKKPPKEFLERFKSLLQKMIHQHLSSRTHGSEDS | 2.5980863 | 2829 |
| IL-21_ 16833 | IL-21_ 5845 | N70G, K81L | MRSSPGNMERIVICLMVIFLGTLVHKSSSQGQDRHMIRMRQLIDIVDQLKNYVNDLVPEFLPAPEDVETGCEWSAFSCFQLAQLKSANTGNNERIINVSIKKLKRKPPSTNAGRRQKHRLTCPSCDSYEKKPPKEFLERFKSLLQKMIHQHLSSRTHGSEDS | 2.601780463 | 2830 |
| IL-21_ 16173 | IL-21_ 5845 | D44T, N70G, K81D | MRSSPGNMERIVICLMVIFLGTLVHKSSSQGQDRHMIRMRQLITIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS | 2.608516191 | 2831 |
| IL-21_ 16166 | IL-21_ 5845 | D44L, N70G, K81D | MRSSPGNMERIVICLMVIFLGTLVHKSSSQGQDRHMIRMRQLILIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS | 2.62310379 | 2832 |
| IL-21_ 17104 | IL-21_ 5845 | N70G, K81D, I96M | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIMNVSIKKLKRKPPSTNAGRRQKHRLTCPSCDSYEKKPPKEFLERFKSLLQKMIHQHLSSRTHGSEDS | 2.623302381 | 2833 |
| IL-21_ 14248 | IL-21_ 6318 | H35F, K81D, V98E, R105F | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKFKPPSTNAGRRQKHRLTCPSCDSYEKKPPKEFLERFKSLLQKMIHQHLSSRTHGSEDS | 2.635990659 | 2834 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 8511 | IL-21_ 4177 | H35I, I37A, N70G, T110D, A112P | MRSSPGNMERIVICLMVIFLGTLVH KSSSQGQDRIMARMRQLIDIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.644676649 | 2835 |
| IL-21_ 15753 | IL-21_ 6018 | H35F, K81D, V98E, R105H, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKHKPPSDNAGRRQKHRLTCPSC DSYEKKPPKEFLERFKSLLQKMIHQ HLSSRTHGSEDS | 2.649459276 | 2836 |
| IL-21_ 13049 | IL-21_ 6318 | H35F, R38L, K81D, V98E | MRSSPGNMERIVICLMVIFLGTLVH KSSSQGQDRFMILMRQLIDIVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 2.653283196 | 2837 |
| IL-21_ 13053 | IL-21_ 6318 | H35F, R38Q, K81D, V98E | MRSSPGNMERIVICLMVIFLGTLVH KSSSQGQDRFMIQMRQLIDIVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 2.656681292 | 2838 |
| IL-21_ 16049 | IL-21_ 5845 | I37W, N70G, K81D | MRSSPGNMERIVICLMVIFLGTLVH KSSSQGQDRHMWRMRQLIDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.657747906 | 2839 |
| IL-21_ 16638 | IL-21_ 5845 | N70R, K81D | MRSSPGNMERIVICLMVIFLGTLVH KSSSQGQDRHMIRMRQLIDIVDQLK NYVNDLVPEFLPAPEDVETRCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.663688686 | 2840 |
| IL-21_ 16642 | IL-21_ 5845 | N70W, K81D | MRSSPGNMERIVICLMVIFLGTLVH KSSSQGQDRHMIRMRQLIDIVDQLK NYVNDLVPEFLPAPEDVETWCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.665361621 | 2841 |
| IL-21_ 7724 | IL-21_ 4177 | H35I, N70G, Q80R, T110D, A112P | MRSSPGNMERIVICLMVIFLGTLVH KSSSQGQDRIMIRMRQLIDIVDQLK NYVNDLVPEFLPAPEDVETGCEWSA FSCFRKAQLKSANTGNNERIINVSI KKLKRKPPSDNPGRRQKHRLTCPSC DSYEKKPPKEFLERFKSLLQKMIHQ HLSSRTHGSEDS | 2.666337783 | 2842 |
| IL-21_ 8229 | IL-21_ 4177 | H35I, Y52Q, N70G, T110D, A112P | MRSSPGNMERIVICLMVIFLGTLVH KSSSQGQDRIMIRMRQLIDIVDQLK NQVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.668012751 | 2843 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 10652 | IL-21_ 3610 | R38K, P107V, R114Q, R115D | MRSSPGNMERIVICLMVIFLGTLVH KSSSQGQDRHMIKMRQLIDIVDQLK NYVNDLVPEFLPAPEDVETNCEWSA FSCFQKAQLKSANTGNNERIINVSI KKLKRKVPSTNAGQDQKHRLTCPSC DSYEKKPPKEFLERFKSLLQKMIHQ HLSSRTHGSEDS | 2.668792411 | 2844 |
| IL-21_ 14097 | IL-21_ 6318 | H35F, K81D, I96S, V98E | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERISNESI KKLKRKPPSTNAGRRQKHRLTCPSC DSYEKKPPKEFLERFKSLLQKMIHQ HLSSRTHGSEDS | 2.67289903 | 2845 |
| IL-21_ 7728 | IL-21_ 4177 | H35I, N70G, Q80L, T110D, A112P | MRSSPGNMERIVICLMVIFLGTLVH KSSSQGQDRIMIRMRQLIDIVDQLK NYVNDLVPEFLPAPEDVETGCEWSA FSCFLKAQLKSANTGNNERIINVSI KKLKRKPPSDNPGRRQKHRLTCPSC DSYEKKPPKEFLERFKSLLQKMIHQ HLSSRTHGSEDS | 2.674310461 | 2846 |
| IL-21_ 7620 | IL-21_ 4177 | H35I, N70G, S86L, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKLANTGNNERIINVSI KKLKRKPPSDNPGRRQKHRLTCPSC DSYEKKPPKEFLERFKSLLQKMIHQ HLSSRTHGSEDS | 2.676341508 | 2847 |
| IL-21_ 16167 | IL-21_ 5845 | D44M, N70G, K81D | MRSSPGNMERIVICLMVIFLGTLVH KSSSQGQDRHMIRMRQLIMIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.692199857 | 2848 |
| IL-21_ 17672 | IL-21_ 5707 | D44P, K81D, V98E, P107V | MRSSPGNMERIVICLMVIFLGTLVH KSSSQGQDRHMIRMRQLIPIVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 2.692737856 | 2849 |
| IL-21_ 9448 | IL-21_ 3610 | R105K, P107V, R114Q, R115D | MRSSPGNMERIVICLMVIFLGTLVH KSSSQGQDRHMIRMRQLIDIVDQLK NYVNDLVPEFLPAPEDVETNCEWSA FSCFQKAQLKSANTGNNERIINVSI KKLKKKVPSTNAGQDQKHRLTCPSC DSYEKKPPKEFLERFKSLLQKMIHQ HLSSRTHGSEDS | 2.701224253 | 2850 |
| IL-21_ 20118 | IL-21_ 5474 | N70G, K81D, I96Y, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIYNVSI KKLKRKPPSTNAGQDQKHRLTCPSC DSYEKKPPKEFLERFKSLLQKMIHQ HLSSRTHGSEDS | 2.715749053 | 2851 |
| IL-21_ 15997 | IL-21_ 5845 | R34W, N70G, K81D | MRSSPGNMERIVICLMVIFLGTLVH KSSSQGQDWHMIRMRQLIDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.718412983 | 2852 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 9446 | IL-21_ 3610 | R105M, P107V, R114Q, R115D | MRSSPGNMERIVICLMVIFLGTLVH KSSSQGQDRHMIRMRQLIDIVDQLK NYVNDLVPEFLPAPEDVETNCEWSA FSCFQKAQLKSANTGNNERIINVSI KKLKMKVPSTNAGQDQKHRLTCPSC DSYEKKPPKEFLERFKSLLQKMIHQ HLSSRTHGSEDS | 2.721161267 | 2853 |
| IL-21_ 16188 | IL-21_ 5845 | I45Q, N70G, K81D | MRSSPGNMERIVICLMVIFLGTLVH KSSSQGQDRHMIRMRQLIDQVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 2.726334267 | 2854 |
| IL-21_ 11676 | IL-21_ 0910 | I45T, K81D, V98E, K102E | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KELKRKPPSTNAGRRQKHRLTCPSC DSYEKKPPKEFLERFKSLLQKMIHQ HLSSRTHGSEDS | 2.726618644 | 2855 |
| IL-21_ 14684 | IL-21_ 6018 | H35F, I45W, K81D, V98E, T110D | MRSSPGNMERIVICLMVIFLGTLVH KSSSQGQDRFMIRMRQLIDWVDQLK NYVNDLVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 2.727394872 | 2856 |
| IL-21_ 20185 | IL-21_ 5474 | N70G, K81D, I100R, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSR KKLKRKPPSTNAGQDQKHRLTCPSC DSYEKKPPKEFLERFKSLLQKMIHQ HLSSRTHGSEDS | 2.729528665 | 2857 |
| IL-21_ 15662 | IL-21_ 6018 | H35F, K81D, V98E, I100G, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESG KKLKRKPPSDNAGRRQKHRLTCPSC DSYEKKPPKEFLERFKSLLQKMIHQ HLSSRTHGSEDS | 2.731308687 | 2858 |
| IL-21_ 17110 | IL-21_ 5845 | N70G, K81D, 196T | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERITNVSI KKLKRKPPSTNAGRRQKHRLTCPSC DSYEKKPPKEFLERFKSLLQKMIHQ HLSSRTHGSEDS | 2.739195456 | 2859 |
| IL-21_ 8376 | IL-21_ 4177 | H35I, D44N, N70G, T110D, A112P | MRSSPGNMERIVICLMVIFLGTLVH KSSSQGQDRIMIRMRQLINIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.739989913 | 2860 |
| IL-21_ 10643 | IL-21_ 3610 | R38W, P107V, R114Q, R115D | MRSSPGNMERIVICLMVIFLGTLVH KSSSQGQDRHMIWMRQLIDIVDQLK NYVNDLVPEFLPAPEDVETNCEWSA FSCFQKAQLKSANTGNNERIINVSI KKLKRKVPSTNAGQDQKHRLTCPSC DSYEKKPPKEFLERFKSLLQKMIHQ HLSSRTHGSEDS | 2.746274627 | 2861 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 16163 | IL-21_ 5845 | D44H, N70G, K81D | MRSSPGNMERIVICLMVIFLGTLVHKSSSQGQDRHMIRMRQLIHIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS | 2.754179299 | 2862 |
| IL-21_ 14126 | IL-21_ 6318 | H35F, K81D, V98K | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINKSIKKLKRKPPSTNAGRRQKHRLTCPSCDSYEKKPPKEFLERFKSLLQKMIHQHLSSRTHGSEDS | 2.757141758 | 2863 |
| IL-21_ 16389 | IL-21_ 5845 | L56V, N70G, K81D | MRSSPGNMERIVICLMVIFLGTLVHKSSSQGQDRHMIRMRQLIDIVDQLKNYVNDVVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS | 2.762131591 | 2864 |
| IL-21_ 19070 | IL-21_ 5474 | R38S, N70G, K81D, R114Q, R115D | MRSSPGNMERIVICLMVIFLGTLVHKSSSQGQDRHMISMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS | 2.769738629 | 2865 |
| IL-21_ 17320 | IL-21_ 5845 | N70G, K81D, P108N | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPNSTNAGRRQKHRLTCPSCDSYEKKPPKEFLERFKSLLQKMIHQHLSSRTHGSEDS | 2.78539456 | 2866 |
| IL-21_ 7220 | IL-21_ 4177 | H35I, N70G, P108R, T110D, A112P | MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPRSDNPGRRQKHRLTCPSCDSYEKKPPKEFLERFKSLLQKMIHQHLSSRTHGSEDS | 2.789039153 | 2867 |
| IL-21_ 19067 | IL-21_ 5474 | R38N, N70G, K81D, R114Q, R115D | MRSSPGNMERIVICLMVIFLGTLVHKSSSQGQDRHMINMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS | 2.798910553 | 2868 |
| IL-21_ 8372 | IL-21_ 4177 | H35I, D44S, N70G, T110D, A112P | MRSSPGNMERIVICLMVIFLGTLVHKSSSQGQDRIMIRMRQLISIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS | 2.8009417 | 2869 |
| IL-21_ 17170 | IL-21_ 5845 | N70G, K81D, I100F | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSFKKLKRKPPSTNAGRRQKHRLTCPSCDSYEKKPPKEFLERFKSLLQKMIHQHLSSRTHGSEDS | 2.8038699 | 2870 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 7277 | IL-21_ 4177 | H35I, N70G, R105M, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKMKPPSDNPGRRQKHRLTCPSC DSYEKKPPKEFLERFKSLLQKMIHQ HLSSRTHGSEDS | 2.819119165 | 2871 |
| IL-21_ 8301 | IL-21_ 4177 | H35I, Q48R, N70G, T110D, A112P | MRSSPGNMERIVICLMVIFLGTLVH KSSSQGQDRIMIRMRQLIDIVDRLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.820651658 | 2872 |
| IL-21_ 8227 | IL-21_ 4177 | H35I, Y52S, N70G, T110D, A112P | MRSSPGNMERIVICLMVIFLGTLVH KSSSQGQDRIMIRMRQLIDIVDQLK NSVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.826366965 | 2873 |
| IL-21_ 15758 | IL-21_ 6018 | H35F, K81D, V98E, R105N, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKNKPPSDNAGRRQKHRLTCPSC DSYEKKPPKEFLERFKSLLQKMIHQ HLSSRTHGSEDS | 2.828170951 | 2874 |
| IL-21_ 7661 | IL-21_ 4177 | H35I, N70G, L84F, T110D, A112P | MRSSPGNMERIVICLMVIFLGTLVH KSSSQGQDRIMIRMRQLIDIVDQLK NYVNDLVPEFLPAPEDVETGCEWSA FSCFQKAQFKSANTGNNERIINVSI KKLKRKPPSDNPGRRQKHRLTCPSC DSYEKKPPKEFLERFKSLLQKMIHQ HLSSRTHGSEDS | 2.831109699 | 2875 |
| IL-21_ 11581 | IL-21_ 0910 | I45T, K81D, V98E, P107K | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KKLKRKKPSTNAGRRQKHRLTCPSC DSYEKKPPKEFLERFKSLLQKMIHQ HLSSRTHGSEDS | 2.836745154 | 2876 |
| IL-21_ 20243 | IL-21_ 5474 | N70G, K81D, L103W, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKWKRKPPSTNAGQDQKHRLTCPSC DSYEKKPPKEFLERFKSLLQKMIHQ HLSSRTHGSEDS | 2.838282098 | 2877 |
| IL-21_ 8226 | IL-21_ 4177 | H35I, Y52T, N70G, T110D, A112P | MRSSPGNMERIVICLMVIFLGTLVH KSSSQGQDRIMIRMRQLIDIVDQLK NTVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 2.84906597 | 2878 |
| IL-21_ 16843 | IL-21_ 5845 | N70G, K81Y | MRSSPGNMERIVICLMVIFLGTLVH KSSSQGQDRHMIRMRQLIDIVDQLK NYVNDLVPEFLPAPEDVETGCEWSA FSCFQYAQLKSANTGNNERIINVSI KKLKRKPPSTNAGRRQKHRLTCPSC DSYEKKPPKEFLERFKSLLQKMIHQ HLSSRTHGSEDS | 2.854741602 | 2879 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 8381 | IL-21_ 4177 | H35I, D44H, N70G, T110D, A112P | MRSSPGNMERIVICLMVIFLGTLVHKSSSQGQDRIMIRMRQLIHIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS | 2.877542296 | 2880 |
| IL-21_ 20272 | IL-21_ 5474 | N70G, K81D, R105M, R114Q, R115D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKMKPPSTNAGQDQKHRLTCPSCDSYEKKPPKEFLERFKSLLQKMIHQHLSSRTHGSEDS | 2.900902787 | 2881 |
| IL-21_ 16679 | IL-21_ 5845 | N70G, E72W, K81D | MRSSPGNMERIVICLMVIFLGTLVHKSSSQGQDRHMIRMRQLIDIVDQLKNYVNDLVPEFLPAPEDVETGCWWSAFSCFQDAQLKSANTGNNERIINVSIKKLKRKPPSTNAGRRQKHRLTCPSCDSYEKKPPKEFLERFKSLLQKMIHQHLSSRTHGSEDS | 2.906096052 | 2882 |
| IL-21_ 13125 | IL-21_ 6318 | H35F, L42R, K81D, V98E | MRSSPGNMERIVICLMVIFLGTLVHKSSSQGQDRFMIRMRQRIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 2.910241775 | 2883 |
| IL-21_ 19065 | IL-21_ 5474 | R38L, N70G, K81D, R114Q, R115D | MRSSPGNMERIVICLMVIFLGTLVHKSSSQGQDRHMILMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS | 2.915413978 | 2884 |
| IL-21_ 8484 | IL-21_ 4177 | H35I, R38M, N70G, T110D, A112P | MRSSPGNMERIVICLMVIFLGTLVHKSSSQGQDRIMIMMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS | 2.921081443 | 2885 |
| IL-21_ 20190 | IL-21_ 5474 | N70G, K81D, I100Y, R114Q, R115D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSYKKLKRKPPSTNAGQDQKHRLTCPSCDSYEKKPPKEFLERFKSLLQKMIHQHLSSRTHGSEDS | 2.932868824 | 2886 |
| IL-21_ 12836 | IL-21_ 0910 | I37P, I45T, K81D, V98E | MRSSPGNMERIVICLMVIFLGTLVHKSSSQGQDRHMPRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 2.946588817 | 2887 |
| IL-21_ 20184 | IL-21_ 5474 | N70G, K81D, I100Q, R114Q, R115D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSQKKLKRKPPSTNAGQDQKHRLTCPSCDSYEKKPPKEFLERFKSLLQKMIHQHLSSRTHGSEDS | 2.947975805 | 2888 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 16832 | IL-21_ 5845 | N70G | MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRRQKHRLTCPSCDSYEKKPPKEFLERFKSLLQKMIHQHLSSRTHGSEDS | 2.96193522 | 2889 |
| IL-21_ 7048 | IL-21_ 4177 | H35I, N70G, T110D, A112P, H118K | MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSDNPGRRQKKRLTCPSCDSYEKKPPKEFLERFKSLLQKMIHQHLSSRTHGSEDS | 2.965522302 | 2890 |
| IL-21_ 7238 | IL-21_ 4177 | H35I, N70G, P107R, T110D, A112P | MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKRPSDNPGRRQKHRLTCPSCDSYEKKPPKEFLERFKSLLQKMIHQHLSSRTHGSEDS | 2.988154844 | 2891 |
| IL-21_ 8506 | IL-21_ 4177 | H35I, I37H, N70G, T110D, A112P | MRSSPGNMERIVICLMVIFLGTLVHKSSSQGQDRIMHRMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS | 2.988623386 | 2892 |
| IL-21_ 15592 | IL-21_ 6018 | H35F, K81D, 196H, V98E, T110D | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIHNESIKKLKRKPPSDNAGRRQKHRLTCPSCDSYEKKPPKEFLERFKSLLQKMIHQHLSSRTHGSEDS | 2.996417155 | 2893 |
| IL-21_ 10647 | IL-21_ 3610 | R38Q, P107V, R114Q, R115D | MRSSPGNMERIVICLMVIFLGTLVHKSSSQGQDRHMIQMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS | 3.036568151 | 2894 |
| IL-21_ 15233 | IL-21_ 6018 | H35F, F76K, K81D, V98E, T110D | MRSSPGNMERIVICLMVIFLGTLVHKSSSQGQDRFMIRMRQLIDIVDQLKNYVNDLVPEFLPAPEDVETNCEWSAKSCFQDAQLKSANTGNNERIINESIKKLKRKPPSDNAGRRQKHRLTCPSCDSYEKKPPKEFLERFKSLLQKMIHQHLSSRTHGSEDS | 3.051342816 | 2895 |
| IL-21_ 7423 | IL-21_ 4177 | H35I, N70G, N97K, T110D, A112P | MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIIKVSIKKLKRKPPSDNPGRRQKHRLTCPSCDSYEKKPPKEFLERFKSLLQKMIHQHLSSRTHGSEDS | 3.11364762 | 2896 |
| IL-21_ 8502 | IL-21_ 4177 | H35I, I37N, N70G, T110D, A112P | MRSSPGNMERIVICLMVIFLGTLVHKSSSQGQDRIMNRMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS | 3.119360137 | 2897 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 16820 | IL-21_ 5845 | N70G, Q80R, K81D | MRSSPGNMERIVICLMVIFLGTLVHKSSSQGQDRHMIRMRQLIDIVDQLKNYVNDLVPEFLPAPEDVETGCEWSAFSCFRDAQLKSANTGNNERIINVSIKKLKRKPPSTNAGRRQKHRLTCPSCDSYEKKPPKEFLERFKSLLQKMIHQHLSSRTHGSEDS | 3.127169028 | 2898 |
| IL-21_ 17090 | IL-21_ 5845 | N70G, K81D, 195R | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERRINVSIKKLKRKPPSTNAGRRQKHRLTCPSCDSYEKKPPKEFLERFKSLLQKMIHQHLSSRTHGSEDS | 3.13173756 | 2899 |
| IL-21_ 8507 | IL-21_ 4177 | H35I, I37G, N70G, T110D, A112P | MRSSPGNMERIVICLMVIFLGTLVHKSSSQGQDRIMGRMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS | 3.136367258 | 2900 |
| IL-21_ 18639 | IL-21_ 5707 | K81D, V98K, P107V | MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINKSIKKLKRKVPSTNAGRRQKHRLTCPSCDSYEKKPPKEFLERFKSLLQKMIHQHLSSRTHGSEDS | 3.138455943 | 2901 |
| IL-21_ 16161 | IL-21_ 5845 | D44F, N70G, K81D | MRSSPGNMERIVICLMVIFLGTLVHKSSSQGQDRHMIRMRQLIFIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS | 3.142408176 | 2902 |
| IL-21_ 16176 | IL-21_ 5845 | D44Y, N70G, K81D | MRSSPGNMERIVICLMVIFLGTLVHKSSSQGQDRHMIRMRQLIYIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS | 3.151484246 | 2903 |
| IL-21_ 12845 | IL-21_ 0910 | I37D, I45T, K81D, V98E | MRSSPGNMERIVICLMVIFLGTLVHKSSSQGQDRHMDRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 3.153238055 | 2904 |
| IL-21_ 7405 | IL-21_ 4177 | H35I, N70G, V98K, T110D, A112P | MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINKSIKKLKRKPPSDNPGRRQKHRLTCPSCDSYEKKPPKEFLERFKSLLQKMIHQHLSSRTHGSEDS | 3.160704939 | 2905 |
| IL-21_ 13106 | IL-21_ 6318 | H35F, Q41P, K81D, V98E | MRSSPGNMERIVICLMVIFLGTLVHKSSSQGQDRFMIRMRPLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 3.164223781 | 2906 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 16830 | IL-21_ 5845 | N70G, K81H | MRSSPGNMERIVICLMVIFLGTLVH KSSSQGQDRHMIRMRQLIDIVDQLK NYVNDLVPEFLPAPEDVETGCEWSA FSCFQHAQLKSANTGNNERIINVSI KKLKRKPPSTNAGRRQKHRLTCPSC DSYEKKPPKEFLERFKSLLQKMIHQ HLSSRTHGSEDS | 3.166775952 | 2907 |
| IL-21_ 16060 | IL-21_ 5845 | R38M, N70G, K81D | MRSSPGNMERIVICLMVIFLGTLVH KSSSQGQDRHMIMMRQLIDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 3.191390571 | 2908 |
| IL-21_ 7283 | IL-21_ 4177 | H35I, N70G, R105F, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKFKPPSDNPGRRQKHRLTCPSC DSYEKKPPKEFLERFKSLLQKMIHQ HLSSRTHGSEDS | 3.199335005 | 2909 |
| IL-21_ 14255 | IL-21_ 6318 | H35F, K81D, V98E, R105N | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKNKPPSTNAGRRQKHRLTCPSC DSYEKKPPKEFLERFKSLLQKMIHQ HLSSRTHGSEDS | 3.199692791 | 2910 |
| IL-21_ 7490 | IL-21_ 4177 | H35I, N70G, E93R, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNRRIINVSI KKLKRKPPSDNPGRRQKHRLTCPSC DSYEKKPPKEFLERFKSLLQKMIHQ HLSSRTHGSEDS | 3.230208648 | 2911 |
| IL-21_ 16192 | IL-21_ 5845 | I45W, N70G, K81D | MRSSPGNMERIVICLMVIFLGTLVH KSSSQGQDRHMIRMRQLIDWVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 3.231264694 | 2912 |
| IL-21_ 7615 | IL-21_ 4177 | H35I, N70G, S86R, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKRANTGNNERIINVSI KKLKRKPPSDNPGRRQKHRLTCPSC DSYEKKPPKEFLERFKSLLQKMIHQ HLSSRTHGSEDS | 3.243193738 | 2913 |
| IL-21_ 10644 | IL-21_ 3610 | R38V, P107V, R114Q, R115D | MRSSPGNMERIVICLMVIFLGTLVH KSSSQGQDRHMIVMRQLIDIVDQLK NYVNDLVPEFLPAPEDVETNCEWSA FSCFQKAQLKSANTGNNERIINVSI KKLKRKVPSTNAGQDQKHRLTCPSC DSYEKKPPKEFLERFKSLLQKMIHQ HLSSRTHGSEDS | 3.244615323 | 2914 |
| IL-21_ 16825 | IL-21_ 5845 | N70G, Q80Y, K81D | MRSSPGNMERIVICLMVIFLGTLVH KSSSQGQDRHMIRMRQLIDIVDQLK NYVNDLVPEFLPAPEDVETGCEWSA FSCFYDAQLKSANTGNNERIINVSI KKLKRKPPSTNAGRRQKHRLTCPSC DSYEKKPPKEFLERFKSLLQKMIHQ HLSSRTHGSEDS | 3.277082194 | 2915 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 7500 | IL-21_ 4177 | H35I, N70G, E93F, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNFRIINVSI KKLKRKPPSDNPGRRQKHRLTCPSC DSYEKKPPKEFLERFKSLLQKMIHQ HLSSRTHGSEDS | 3.281300673 | 2916 |
| IL-21_ 8499 | IL-21_ 4177 | H35I, I37R, N70G, T110D, A112P | MRSSPGNMERIVICLMVIFLGTLVH KSSSQGQDRIMRRMRQLIDIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 3.286103083 | 2917 |
| IL-21_ 8356 | IL-21_ 4177 | H35I, I45Q, N70G, T110D, A112P | MRSSPGNMERIVICLMVIFLGTLVH KSSSQGQDRIMIRMRQLIDQVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 3.28782226 | 2918 |
| IL-21_ 16037 | IL-21_ 5845 | I37G, N70G, K81D | MRSSPGNMERIVICLMVIFLGTLVH KSSSQGQDRHMGRMRQLIDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 3.302128872 | 2919 |
| IL-21_ 7373 | IL-21_ 4177 | H35I, N70G, I100F, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSF KKLKRKPPSDNPGRRQKHRLTCPSC DSYEKKPPKEFLERFKSLLQKMIHQ HLSSRTHGSEDS | 3.309233762 | 2920 |
| IL-21_ 16809 | IL-21_ 5845 | N70G, Q80D, K81D | MRSSPGNMERIVICLMVIFLGTLVH KSSSQGQDRHMIRMRQLIDIVDQLK NYVNDLVPEFLPAPEDVETGCEWSA FSCFDDAQLKSANTGNNERIINVSI KKLKRKPPSTNAGRRQKHRLTCPSC DSYEKKPPKEFLERFKSLLQKMIHQ HLSSRTHGSEDS | 3.315420414 | 2921 |
| IL-21_ 12758 | IL-21_ 0910 | Q41W, I45T, K81D, V98E | MRSSPGNMERIVICLMVIFLGTLVH KSSSQGQDRHMIRMRWLIDTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 3.327691602 | 2922 |
| IL-21_ 16045 | IL-21_ 5845 | I37R, N70G, K81D | MRSSPGNMERIVICLMVIFLGTLVH KSSSQGQDRHMRRMRQLIDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 3.351454304 | 2923 |
| IL-21_ 15754 | IL-21_ 6018 | H35F, K81D, V98E, R105I, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKIKPPSDNAGRRQKHRLTCPSC DSYEKKPPKEFLERFKSLLQKMIHQ HLSSRTHGSEDS | 3.368156674 | 2924 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 9439 | IL-21_ 3610 | R105W, P107V, R114Q, R115D | MRSSPGNMERIVICLMVIFLGTLVH KSSSQGQDRHMIRMRQLIDIVDQLK NYVNDLVPEFLPAPEDVETNCEWSA FSCFQKAQLKSANTGNNERIINVSI KKLKWKVPSTNAGQDQKHRLTCPSC DSYEKKPPKEFLERFKSLLQKMIHQ HLSSRTHGSEDS | 3.371181863 | 2925 |
| IL-21_ 8486 | IL-21_ 4177 | H35I, R38K, N70G, T110D, A112P | MRSSPGNMERIVICLMVIFLGTLVH KSSSQGQDRIMIKMRQLIDIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 3.375843198 | 2926 |
| IL-21_ 7720 | IL-21_ 4177 | H35I, N70G, Q80W, T110D, A112P | MRSSPGNMERIVICLMVIFLGTLVH KSSSQGQDRIMIRMRQLIDIVDQLK NYVNDLVPEFLPAPEDVETGCEWSA FSCFWKAQLKSANTGNNERIINVSI KKLKRKPPSDNPGRRQKHRLTCPSC DSYEKKPPKEFLERFKSLLQKMIHQ HLSSRTHGSEDS | 3.381621332 | 2927 |
| IL-21_ 17180 | IL-21_ 5845 | N70G, K81D, I100S | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSS KKLKRKPPSTNAGRRQKHRLTCPSC DSYEKKPPKEFLERFKSLLQKMIHQ HLSSRTHGSEDS | 3.389250362 | 2928 |
| IL-21_ 7225 | IL-21_ 4177 | H35I, N70G, P108K, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKRKPKSDNPGRRQKHRLTCPSC DSYEKKPPKEFLERFKSLLQKMIHQ HLSSRTHGSEDS | 3.399062081 | 2929 |
| IL-21_ 8368 | IL-21_ 4177 | H35I, D44Y, N70G, T110D, A112P | MRSSPGNMERIVICLMVIFLGTLVH KSSSQGQDRIMIRMRQLIYIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 3.400389857 | 2930 |
| IL-21_ 8383 | IL-21_ 4177 | H35I, D44F, N70G, T110D, A112P | MRSSPGNMERIVICLMVIFLGTLVH KSSSQGQDRIMIRMRQLIFIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 3.404819539 | 2931 |
| IL-21_ 16741 | IL-21_ 5845 | N70G, F76K, K81D | MRSSPGNMERIVICLMVIFLGTLVH KSSSQGQDRHMIRMRQLIDIVDQLK NYVNDLVPEFLPAPEDVETGCEWSA KSCFQDAQLKSANTGNNERIINVSI KKLKRKPPSTNAGRRQKHRLTCPSC DSYEKKPPKEFLERFKSLLQKMIHQ HLSSRTHGSEDS | 3.411539655 | 2932 |
| IL-21_ 12812 | IL-21_ 0910 | R38W, I45T, K81D, V98E | MRSSPGNMERIVICLMVIFLGTLVH KSSSQGQDRHMIWMRQLIDTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 3.411894421 | 2933 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 10646 | IL-21_ 3610 | R38S, P107V, R114Q, R115D | MRSSPGNMERIVICLMVIFLGTLVHKSSSQGQDRHMISMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS | 3.41405973 | 2934 |
| IL-21_ 19801 | IL-21_ 5474 | N70G, F79I, K81D, R114Q, R115D | MRSSPGNMERIVICLMVIFLGTLVHKSSSQGQDRHMIRMRQLIDIVDQLKNYVNDLVPEFLPAPEDVETGCEWSAFSCIQDAQLKSANTGNNERIINVSIKKLKRKPPSTNAGQDQKHRLTCPSCDSYEKKPPKEFLERFKSLLQKMIHQHLSSRTHGSEDS | 3.418452293 | 2935 |
| IL-21_ 12806 | IL-21_ 0910 | M39G, I45T, K81D, V98E | MRSSPGNMERIVICLMVIFLGTLVHKSSSQGQDRHMIRGRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 3.434670766 | 2936 |
| IL-21_ 20175 | IL-21_ 5474 | N70G, K81D, I100E, R114Q, R115D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSEKKLKRKPPSTNAGQDQKHRLTCPSCDSYEKKPPKEFLERFKSLLQKMIHQHLSSRTHGSEDS | 3.44986491 | 2937 |
| IL-21_ 9443 | IL-21_ 3610 | R105Q, P107V, R114Q, R115D | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKQKVPSTNAGQDQKHRLTCPSCDSYEKKPPKEFLERFKSLLQKMIHQHLSSRTHGSEDS | 3.455455431 | 2938 |
| IL-21_ 7286 | IL-21_ 4177 | H35I, N70G, R105A, T110D, A112P | MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKAKPPSDNPGRRQKHRLTCPSCDSYEKKPPKEFLERFKSLLQKMIHQHLSSRTHGSEDS | 3.459453592 | 2939 |
| IL-21_ 7276 | IL-21_ 4177 | H35I, N70G, R105N, T110D, A112P | MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKNKPPSDNPGRRQKHRLTCPSCDSYEKKPPKEFLERFKSLLQKMIHQHLSSRTHGSEDS | 3.461896853 | 2940 |
| IL-21_ 18770 | IL-21_ 5707 | K81D, V98E, R105Q, P107V | MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKQKVPSTNAGRRQKHRLTCPSCDSYEKKPPKEFLERFKSLLQKMIHQHLSSRTHGSEDS | 3.47204279 | 2941 |
| IL-21_ 15748 | IL-21_ 6018 | H35F, K81D, V98E, R105A, T110D | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKAKPPSDNAGRRQKHRLTCPSCDSYEKKPPKEFLERFKSLLQKMIHQHLSSRTHGSEDS | 3.478147566 | 2942 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 18771 | IL-21_ 5707 | K81D, V98E, R105S, P107V | MRSSPGNMERIVICLMVIFLGTLVH KSSSQGQDRHMIRMRQLIDIVDQLK NYVNDLVPEFLPAPEDVETNCEWSA FSCFQDAQLKSANTGNNERIINESI KKLKSKVPSTNAGRRQKHRLTCPSC DSYEKKPPKEFLERFKSLLQKMIHQ HLSSRTHGSEDS | 3.487864361 | 2943 |
| IL-21_ 17054 | IL-21_ 5845 | N70G, K81D, E93R | MRSSPGNMERIVICLMVIFLGTLVH KSSSQGQDRHMIRMRQLIDIVDQLK NYVNDLVPEFLPAPEDVETGCEWSA FSCFQDAQLKSANTGNNRRIINVSI KKLKRKPPSTNAGRRQKHRLTCPSC DSYEKKPPKEFLERFKSLLQKMIHQ HLSSRTHGSEDS | 3.496746132 | 2944 |
| IL-21_ 7387 | IL-21_ 4177 | H35I, N70G, S99K, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVKI KKLKRKPPSDNPGRRQKHRLTCPSC DSYEKKPPKEFLERFKSLLQKMIHQ HLSSRTHGSEDS | 3.506972125 | 2945 |
| IL-21_ 12840 | IL-21_ 0910 | I37K, I45T, K81D, V98E | MRSSPGNMERIVICLMVIFLGTLVH KSSSQGQDRHMKRMRQLIDTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 3.514697591 | 2946 |
| IL-21_ 9442 | IL-21_ 3610 | R105S, P107V, R114Q, R115D | MRSSPGNMERIVICLMVIFLGTLVH KSSSQGQDRHMIRMRQLIDIVDQLK NYVNDLVPEFLPAPEDVETNCEWSA FSCFQKAQLKSANTGNNERIINVSI KKLKSKVPSTNAGQDQKHRLTCPSC DSYEKKPPKEFLERFKSLLQKMIHQ HLSSRTHGSEDS | 3.520588841 | 2947 |
| IL-21_ 8155 | IL-21_ 4177 | H35I, L56T, N70G, T110D, A112P | MRSSPGNMERIVICLMVIFLGTLVH KSSSQGQDRIMIRMRQLIDIVDQLK NYVNDTVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 3.523301371 | 2948 |
| IL-21_ 20105 | IL-21_ 5474 | N70G, K81D, 196G, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIGNVSI KKLKRKPPSTNAGQDQKHRLTCPSC DSYEKKPPKEFLERFKSLLQKMIHQ HLSSRTHGSEDS | 3.524841311 | 2949 |
| IL-21_ 18764 | IL-21_ 5707 | K81D, V98E, R105I, P107V | MRSSPGNMERIVICLMVIFLGTLVH KSSSQGQDRHMIRMRQLIDIVDQLK NYVNDLVPEFLPAPEDVETNCEWSA FSCFQDAQLKSANTGNNERIINESI KKLKIKVPSTNAGRRQKHRLTCPSC DSYEKKPPKEFLERFKSLLQKMIHQ HLSSRTHGSEDS | 3.530023215 | 2950 |
| IL-21_ 17568 | IL-21_ 5707 | R38T, K81D, V98E, P107V | MRSSPGNMERIVICLMVIFLGTLVH KSSSQGQDRHMITMRQLIDIVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 3.549898707 | 2951 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 17569 | IL-21_ 5707 | R38V, K81D, V98E, P107V | MRSSPGNMERIVICLMVIFLGTLVH KSSSQGQDRHMIVMRQLIDIVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 3.568737131 | 2952 |
| IL-21_ 8228 | IL-21_ 4177 | H35I, Y52R, N70G, T110D, A112P | MRSSPGNMERIVICLMVIFLGTLVH KSSSQGQDRIMIRMRQLIDIVDQLK NRVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 3.569542306 | 2953 |
| IL-21_ 17138 | IL-21_ 5845 | N70G, K81D, V98K | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINKSI KKLKRKPPSTNAGRRQKHRLTCPSC DSYEKKPPKEFLERFKSLLQKMIHQ HLSSRTHGSEDS | 3.569702787 | 2954 |
| IL-21_ 7679 | IL-21_ 4177 | H35I, N70G, Q83F, T110D, A112P | MRSSPGNMERIVICLMVIFLGTLVH KSSSQGQDRIMIRMRQLIDIVDQLK NYVNDLVPEFLPAPEDVETGCEWSA FSCFQKAFLKSANTGNNERIINVSI KKLKRKPPSDNPGRRQKHRLTCPSC DSYEKKPPKEFLERFKSLLQKMIHQ HLSSRTHGSEDS | 3.575916274 | 2955 |
| IL-21_ 16042 | IL-21_ 5845 | I37N, N70G, K81D | MRSSPGNMERIVICLMVIFLGTLVH KSSSQGQDRHMNRMRQLIDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 3.578238601 | 2956 |
| IL-21_ 16815 | IL-21_ 5845 | N70G, Q80K, K81D | MRSSPGNMERIVICLMVIFLGTLVH KSSSQGQDRHMIRMRQLIDIVDQLK NYVNDLVPEFLPAPEDVETGCEWSA FSCFKDAQLKSANTGNNERIINVSI KKLKRKPPSTNAGRRQKHRLTCPSC DSYEKKPPKEFLERFKSLLQKMIHQ HLSSRTHGSEDS | 3.581433031 | 2957 |
| IL-21_ 8481 | IL-21_ 4177 | H35I, R38Q, N70G, T110D, A112P | MRSSPGNMERIVICLMVIFLGTLVH KSSSQGQDRIMIQMRQLIDIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 3.584276883 | 2958 |
| IL-21_ 7274 | IL-21_ 4177 | H35I, N70G, R105Q, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKQKPPSDNPGRRQKHRLTCPSC DSYEKKPPKEFLERFKSLLQKMIHQ HLSSRTHGSEDS | 3.585853039 | 2959 |
| IL-21_ 16865 | IL-21_ 5845 | N70G, K81D, Q83F | MRSSPGNMERIVICLMVIFLGTLVH KSSSQGQDRHMIRMRQLIDIVDQLK NYVNDLVPEFLPAPEDVETGCEWSA FSCFQDAFLKSANTGNNERIINVSI KKLKRKPPSTNAGRRQKHRLTCPSC DSYEKKPPKEFLERFKSLLQKMIHQ HLSSRTHGSEDS | 3.597961607 | 2960 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 8373 | IL-21_ 4177 | H35I, D44R, N70G, T110D, A112P | MRSSPGNMERIVICLMVIFLGTLVHKSSSQGQDRIMIRMRQLIRIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS | 3.615626647 | 2961 |
| IL-21_ 20102 | IL-21_ 5474 | N70G, K81D, 196D, R114Q, R115D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIDNVSIKKLKRKPPSTNAGQDQKHRLTCPSCDSYEKKPPKEFLERFKSLLQKMIHQHLSSRTHGSEDS | 3.620616267 | 2962 |
| IL-21_ 20111 | IL-21_ 5474 | N70G, K81D, 196P, R114Q, R115D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIPNVSIKKLKRKPPSTNAGQDQKHRLTCPSCDSYEKKPPKEFLERFKSLLQKMIHQHLSSRTHGSEDS | 3.621109833 | 2963 |
| IL-21_ 20177 | IL-21_ 5474 | N70G, K81D, I100G, R114Q, R115D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSGKKLKRKPPSTNAGQDQKHRLTCPSCDSYEKKPPKEFLERFKSLLQKMIHQHLSSRTHGSEDS | 3.623816296 | 2964 |
| IL-21_ 16870 | IL-21_ 5845 | N70G, K81D, Q83L | MRSSPGNMERIVICLMVIFLGTLVHKSSSQGQDRHMIRMRQLIDIVDQLKNYVNDLVPEFLPAPEDVETGCEWSAFSCFQDALLKSANTGNNERIINVSIKKLKRKPPSTNAGRRQKHRLTCPSCDSYEKKPPKEFLERFKSLLQKMIHQHLSSRTHGSEDS | 3.623851026 | 2965 |
| IL-21_ 20244 | IL-21_ 5474 | N70G, K81D, L103Y, R114Q, R115D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKYKRKPPSTNAGQDQKHRLTCPSCDSYEKKPPKEFLERFKSLLQKMIHQHLSSRTHGSEDS | 3.628637807 | 2966 |
| IL-21_ 20280 | IL-21_ 5474 | N70G, K81D, R105Y, R114Q, R115D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKYKPPSTNAGQDQKHRLTCPSCDSYEKKPPKEFLERFKSLLQKMIHQHLSSRTHGSEDS | 3.630497738 | 2967 |
| IL-21_ 9445 | IL-21_ 3610 | R105N, P107V, R114Q, R115D | MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKNKVPSTNAGQDQKHRLTCPSCDSYEKKPPKEFLERFKSLLQKMIHQHLSSRTHGSEDS | 3.63934268 | 2968 |
| IL-21_ 12844 | IL-21_ 0910 | I37E, I45T, K81D, V98E | MRSSPGNMERIVICLMVIFLGTLVHKSSSQGQDRHMERMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 3.640175379 | 2969 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 7434 | IL-21_ 4177 | H35I, N70G, I96T, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERITNVSI KKLKRKPPSDNPGRRQKHRLTCPSC DSYEKKPPKEFLERFKSLLQKMIHQ HLSSRTHGSEDS | 3.643252905 | 2970 |
| IL-21_ 17224 | IL-21_ 5845 | N70G, K81D, L103F | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKEKRKPPSTNAGRRQKHRLTCPSC DSYEKKPPKEFLERFKSLLQKMIHQ HLSSRTHGSEDS | 3.645383827 | 2971 |
| IL-21_ 14556 | IL-21_ 6018 | H35F, R38T, K81D, V98E, T110D | MRSSPGNMERIVICLMVIFLGTLVH KSSSQGQDRFMITMRQLIDIVDQLK NYVNDLVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 3.646303864 | 2972 |
| IL-21_ 7271 | IL-21_ 4177 | H35I, N70G, R105V, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKVKPPSDNPGRRQKHRLTCPSC DSYEKKPPKEFLERFKSLLQKMIHQ HLSSRTHGSEDS | 3.648609508 | 2973 |
| IL-21_ 8493 | IL-21_ 4177 | H35I, R38A, N70G, T110D, A112P | MRSSPGNMERIVICLMVIFLGTLVH KSSSQGQDRIMIAMRQLIDIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 3.653548636 | 2974 |
| IL-21_ 7280 | IL-21_ 4177 | H35I, N70G, R105I, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKIKPPSDNPGRRQKHRLTCPSC DSYEKKPPKEFLERFKSLLQKMIHQ HLSSRTHGSEDS | 3.654421624 | 2975 |
| IL-21_ 17560 | IL-21_ 5707 | R38I, K81D, V98E, P107V | MRSSPGNMERIVICLMVIFLGTLVH KSSSQGQDRHMIIMRQLIDIVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 3.663092481 | 2976 |
| IL-21_ 14674 | IL-21_ 6018 | H35F, I45K, K81D, V98E, T110D | MRSSPGNMERIVICLMVIFLGTLVH KSSSQGQDRFMIRMRQLIDKVDQLK NYVNDLVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 3.66817399 | 2977 |
| IL-21_ 11617 | IL-21_ 0910 | I45T, K81D, V98E, R105K | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KKLKKKPPSTNAGRRQKHRLTCPSC DSYEKKPPKEFLERFKSLLQKMIHQ HLSSRTHGSEDS | 3.674727658 | 2978 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 15760 | IL-21_ 6018 | H35F, K81D, V98E, R105Q, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKQKPPSDNAGRRQKHRLTCPSC DSYEKKPPKEFLERFKSLLQKMIHQ HLSSRTHGSEDS | 3.684875474 | 2979 |
| IL-21_ 17160 | IL-21_ 5845 | N70G, K81D, S99P | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVPI KKLKRKPPSTNAGRRQKHRLTCPSC DSYEKKPPKEFLERFKSLLQKMIHQ HLSSRTHGSEDS | 3.687663366 | 2980 |
| IL-21_ 13051 | IL-21_ 6318 | H35F, R38N, K81D, V98E | MRSSPGNMERIVICLMVIFLGTLVH KSSSQGQDRFMINMRQLIDIVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 3.690168988 | 2981 |
| IL-21_ 20114 | IL-21_ 5474 | N70G, K81D, I96S, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERISNVSI KKLKRKPPSTNAGQDQKHRLTCPSC DSYEKKPPKEFLERFKSLLQKMIHQ HLSSRTHGSEDS | 3.698970737 | 2982 |
| IL-21_ 20275 | IL-21_ 5474 | N70G, K81D, R105Q, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKQKPPSTNAGQDQKHRLTCPSC DSYEKKPPKEFLERFKSLLQKMIHQ HLSSRTHGSEDS | 3.707179585 | 2983 |
| IL-21_ 7272 | IL-21_ 4177 | H35I, N70G, R105T, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKTKPPSDNPGRRQKHRLTCPSC DSYEKKPPKEFLERFKSLLQKMIHQ HLSSRTHGSEDS | 3.708291658 | 2984 |
| IL-21_ 19122 | IL-21_ 5474 | Q41P, N70G, K81D, R114Q, R115D | MRSSPGNMERIVICLMVIFLGTLVH KSSSQGQDRHMIRMRPLIDIVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 3.710581777 | 2985 |
| IL-21_ 20266 | IL-21_ 5474 | N70G, K81D, R105F, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKFKPPSTNAGQDQKHRLTCPSC DSYEKKPPKEFLERFKSLLQKMIHQ HLSSRTHGSEDS | 3.7121124 | 2986 |
| IL-21_ 19118 | IL-21_ 5474 | Q41K, N70G, K81D, R114Q, R115D | MRSSPGNMERIVICLMVIFLGTLVH KSSSQGQDRHMIRMRKLIDIVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 3.725656386 | 2987 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 14261 | IL-21_ 6318 | H35F, K81D, V98E, R105W | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKWKPPSTNAGRRQKHRLTCPSC DSYEKKPPKEFLERFKSLLQKMIHQ HLSSRTHGSEDS | 3.739763992 | 2988 |
| IL-21_ 15761 | IL-21_ 6018 | H35F, K81D, V98E, R105S, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKSKPPSDNAGRRQKHRLTCPSC DSYEKKPPKEFLERFKSLLQKMIHQ HLSSRTHGSEDS | 3.740015673 | 2989 |
| IL-21_ 8379 | IL-21_ 4177 | H35I, D44K, N70G, T110D, A112P | MRSSPGNMERIVICLMVIFLGTLVH KSSSQGQDRIMIRMRQLIKIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 3.744825187 | 2990 |
| IL-21_ 12896 | IL-21_ 0910 | R34E, I45T, K81D, V98E | MRSSPGNMERIVICLMVIFLGTLVH KSSSQGQDEHMIRMRQLIDTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 3.777914781 | 2991 |
| IL-21_ 17162 | IL-21_ 5845 | N70G, K81D, S99R | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVRI KKLKRKPPSTNAGRRQKHRLTCPSC DSYEKKPPKEFLERFKSLLQKMIHQ HLSSRTHGSEDS | 3.77984391 | 2992 |
| IL-21_ 7666 | IL-21_ 4177 | H35I, N70G, Q83W, T110D, A112P | MRSSPGNMERIVICLMVIFLGTLVH KSSSQGQDRIMIRMRQLIDIVDQLK NYVNDLVPEFLPAPEDVETGCEWSA FSCFQKAWLKSANTGNNERIINVSI KKLKRKPPSDNPGRRQKHRLTCPSC DSYEKKPPKEFLERFKSLLQKMIHQ HLSSRTHGSEDS | 3.791582231 | 2993 |
| IL-21_ 15762 | IL-21_ 6018 | H35F, K81D, V98E, R105T, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKTKPPSDNAGRRQKHRLTCPSC DSYEKKPPKEFLERFKSLLQKMIHQ HLSSRTHGSEDS | 3.80013393 | 2994 |
| IL-21_ 13047 | IL-21_ 6318 | H35F, R38I, K81D, V98E | MRSSPGNMERIVICLMVIFLGTLVH KSSSQGQDREMIIMRQLIDIVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 3.801152304 | 2995 |
| IL-21_ 16065 | IL-21_ 5845 | R38T, N70G, K81D | MRSSPGNMERIVICLMVIFLGTLVH KSSSQGQDRHMITMRQLIDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 3.806207894 | 2996 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 9449 | IL-21_ 3610 | R105I, P107V, R114Q, R115D | MRSSPGNMERIVICLMVIFLGTLVH KSSSQGQDRHMIRMRQLIDIVDQLK NYVNDLVPEFLPAPEDVETNCEWSA FSCFQKAQLKSANTGNNERIINVSI KKLKIKVPSTNAGQDQKHRLTCPSC DSYEKKPPKEFLERFKSLLQKMIHQ HLSSRTHGSEDS | 3.808276608 | 2997 |
| IL-21_ 16057 | IL-21_ 5845 | R38I, N70G, K81D | MRSSPGNMERIVICLMVIFLGTLVH KSSSQGQDRHMIIMRQLIDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 3.808961926 | 2998 |
| IL-21_ 8479 | IL-21_ 4177 | H35I, R38T, N70G, T110D, A112P | MRSSPGNMERIVICLMVIFLGTLVH KSSSQGQDRIMITMRQLIDIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 3.822920385 | 2999 |
| IL-21_ 13042 | IL-21_ 6318 | H35F, R38D, K81D, V98E | MRSSPGNMERIVICLMVIFLGTLVH KSSSQGQDRFMIDMRQLIDIVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 3.830604898 | 3000 |
| IL-21_ 16112 | IL-21_ 5845 | Q41K, N70G, K81D | MRSSPGNMERIVICLMVIFLGTLVH KSSSQGQDRHMIRMRKLIDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 3.841211608 | 3001 |
| IL-21_ 13730 | IL-21_ 6318 | H35F, F76K, K81D, V98E | MRSSPGNMERIVICLMVIFLGTLVH KSSSQGQDRFMIRMRQLIDIVDQLK NYVNDLVPEFLPAPEDVETNCEWSA KSCFQDAQLKSANTGNNERIINESI KKLKRKPPSTNAGRRQKHRLTCPSC DSYEKKPPKEFLERFKSLLQKMIHQ HLSSRTHGSEDS | 3.849028724 | 3002 |
| IL-21_ 14245 | IL-21_ 6318 | H35F, K81D, V98E, R105A | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKAKPPSTNAGRRQKHRLTCPSC DSYEKKPPKEFLERFKSLLQKMIHQ HLSSRTHGSEDS | 3.855516361 | 3003 |
| IL-21_ 17562 | IL-21_ 5707 | R38L, K81D, V98E, P107V | MRSSPGNMERIVICLMVIFLGTLVH KSSSQGQDRHMILMRQLIDIVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 3.8561938 | 3004 |
| IL-21_ 10649 | IL-21_ 3610 | R38N, P107V, R114Q, R115D | MRSSPGNMERIVICLMVIFLGTLVH KSSSQGQDRHMINMRQLIDIVDQLK NYVNDLVPEFLPAPEDVETNCEWSA FSCFQKAQLKSANTGNNERIINVSI KKLKRKVPSTNAGQDQKHRLTCPSC DSYEKKPPKEFLERFKSLLQKMIHQ HLSSRTHGSEDS | 3.856925011 | 3005 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 15764 | IL-21_ 6018 | H35F, K81D, V98E, R105W, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKWKPPSDNAGRRQKHRLTCPSC DSYEKKPPKEFLERFKSLLQKMIHQ HLSSRTHGSEDS | 3.858793268 | 3006 |
| IL-21_ 16051 | IL-21_ 5845 | R38A, N70GK81D | MRSSPGNMERIVICLMVIFLGTLVH KSSSQGQDRHMIAMRQLIDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 3.876216314 | 3007 |
| IL-21_ 17265 | IL-21_ 5845 | N70G, K81D, R105L | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKLKPPSTNAGRRQKHRLTCPSC DSYEKKPPKEFLERFKSLLQKMIHQ HLSSRTHGSEDS | 3.879852172 | 3008 |
| IL-21_ 17322 | IL-21_ 5845 | N70G, K81D, P108R | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKRKPRSTNAGRRQKHRLTCPSC DSYEKKPPKEFLERFKSLLQKMIHQ HLSSRTHGSEDS | 3.888941657 | 3009 |
| IL-21_ 19072 | IL-21_ 5474 | R38V, N70G, K81D, R114Q, R115D | MRSSPGNMERIVICLMVIFLGTLVH KSSSQGQDRHMIVMRQLIDIVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 3.896952246 | 3010 |
| IL-21_ 17564 | IL-21_ 5707 | R38N, K81D, V98E, P107V | MRSSPGNMERIVICLMVIFLGTLVH KSSSQGQDRHMINMRQLIDIVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 3.90112088 | 3011 |
| IL-21_ 12822 | IL-21_ 0910 | R38I, I45T, K81D, V98E | MRSSPGNMERIVICLMVIFLGTLVH KSSSQGQDRHMIIMRQLIDTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 3.901230692 | 3012 |
| IL-21_ 17555 | IL-21_ 5707 | R38D, K81D, V98E, P107V | MRSSPGNMERIVICLMVIFLGTLVH KSSSQGQDRHMIDMRQLIDIVDQLK NYVNDLVPEFLPAPEDVETNCEWSA FSCFQDAQLKSANTGNNERIINESI KKLKRKVPSTNAGRRQKHRLTCPSC DSYEKKPPKEFLERFKSLLQKMIHQ HLSSRTHGSEDS | 3.909666172 | 3013 |
| IL-21_ 11622 | IL-21_ 0910 | I45T, K81D, V98E, R105E | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KKLKEKPPSTNAGRRQKHRLTCPSC DSYEKKPPKEFLERFKSLLQKMIHQ HLSSRTHGSEDS | 3.925613904 | 3014 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 17274 | IL-21_ 5845 | N70G, K81D, R105Y | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKYKPPSTNAGRRQKHRLTCPSCDSYEKKPPKEFLERFKSLLQKMIHQHLSSRTHGSEDS | 3.932332122 | 3015 |
| IL-21_ 17236 | IL-21_ 5845 | N70G, K81D, L103V | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKVKRKPPSTNAGRRQKHRLTCPSCDSYEKKPPKEFLERFKSLLQKMIHQHLSSRTHGSEDS | 3.93763486 | 3016 |
| IL-21_ 18762 | IL-21_ 5707 | K81D, V98E, R105G, P107V | MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKGKVPSTNAGRRQKHRLTCPSCDSYEKKPPKEFLERFKSLLQKMIHQHLSSRTHGSEDS | 3.945929914 | 3017 |
| IL-21_ 12820 | IL-21_ 0910 | R38L, I45T, K81D, V98E | MRSSPGNMERIVICLMVIFLGTLVHKSSSQGQDRHMILMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 3.946176705 | 3018 |
| IL-21_ 12827 | IL-21_ 0910 | R38D, I45T, K81D, V98E | MRSSPGNMERIVICLMVIFLGTLVHKSSSQGQDRHMIDMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 3.950887324 | 3019 |
| IL-21_ 15663 | IL-21_ 6018 | H35F, K81D, V98E, I100H, T110D | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESHKKLKRKPPSDNAGRRQKHRLTCPSCDSYEKKPPKEFLERFKSLLQKMIHQHLSSRTHGSEDS | 3.963326266 | 3020 |
| IL-21_ 7307 | IL-21_ 4177 | H35I, N70G, L103V, T110D, A112P | MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKVKRKPPSDNPGRRQKHRLTCPSCDSYEKKPPKEFLERFKSLLQKMIHQHLSSRTHGSEDS | 3.963455059 | 3021 |
| IL-21_ 16878 | IL-21_ 5845 | N70G, K81D, Q83W | MRSSPGNMERIVICLMVIFLGTLVHKSSSQGQDRHMIRMRQLIDIVDQLKNYVNDLVPEFLPAPEDVETGCEWSAFSCFQDAWLKSANTGNNERIINVSIKKLKRKPPSTNAGRRQKHRLTCPSCDSYEKKPPKEFLERFKSLLQKMIHQHLSSRTHGSEDS | 3.966205226 | 3022 |
| IL-21_ 12897 | IL-21_ 0910 | R34D, I45T, K81D, V98E | MRSSPGNMERIVICLMVIFLGTLVHKSSSQGQDDHMIRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 3.970170078 | 3023 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 20273 | IL-21_ 5474 | N70G, K81D, R105N, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKNKPPSTNAGQDQKHRLTCPSC DSYEKKPPKEFLERFKSLLQKMIHQ HLSSRTHGSEDS | 3.98455441 | 3024 |
| IL-21_ 12818 | IL-21_ 0910 | R38N, I45T, K81D, V98E | MRSSPGNMERIVICLMVIFLGTLVH KSSSQGQDRHMINMRQLIDTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 3.984608757 | 3025 |
| IL-21_ 17266 | IL-21_ 5845 | N70G, K81DR105M | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKMKPPSTNAGRRQKHRLTCPSC DSYEKKPPKEFLERFKSLLQKMIHQ HLSSRTHGSEDS | 3.992191659 | 3026 |
| IL-21_ 8351 | IL-21_ 4177 | H35I, I45W, N70G, T110D, A112P | MRSSPGNMERIVICLMVIFLGTLVH KSSSQGQDRIMIRMRQLIDWVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 4.01136832 | 3027 |
| IL-21_ 17098 | IL-21_ 5845 | N70G, K81D, 196E | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIENVSI KKLKRKPPSTNAGRRQKHRLTCPSC DSYEKKPPKEFLERFKSLLQKMIHQ HLSSRTHGSEDS | 4.016841295 | 3028 |
| IL-21_ 20174 | IL-21_ 5474 | N70G, K81D, I100D, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSD KKLKRKPPSTNAGQDQKHRLTCPSC DSYEKKPPKEFLERFKSLLQKMIHQ HLSSRTHGSEDS | 4.017409114 | 3029 |
| IL-21_ 10648 | IL-21_ 3610 | R38P, P107V, R114Q, R115D | MRSSPGNMERIVICLMVIFLGTLVH KSSSQGQDRHMIPMRQLIDIVDQLK NYVNDLVPEFLPAPEDVETNCEWSA FSCFQKAQLKSANTGNNERIINVSI KKLKRKVPSTNAGQDQKHRLTCPSC DSYEKKPPKEFLERFKSLLQKMIHQ HLSSRTHGSEDS | 4.027278482 | 3030 |
| IL-21_ 19058 | IL-21_ 5474 | R38D, N70G, K81D, R114Q, R115D | MRSSPGNMERIVICLMVIFLGTLVH KSSSQGQDRHMIDMRQLIDIVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 4.027943568 | 3031 |
| IL-21_ 8492 | IL-21_ 4177 | H35I, R38D, N70G, T110D, A112P | MRSSPGNMERIVICLMVIFLGTLVH KSSSQGQDRIMIDMRQLIDIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 4.031778951 | 3032 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 11616 | IL-21_ 0910 | I45T, K81D, V98E, R105L | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KKLKLKPPSTNAGRRQKHRLTCPSC DSYEKKPPKEFLERFKSLLQKMIHQ HLSSRTHGSEDS | 4.032392008 | 3033 |
| IL-21_ 17105 | IL-21_ 5845 | N70G, K81D, 196N | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERINNVSI KKLKRKPPSTNAGRRQKHRLTCPSC DSYEKKPPKEFLERFKSLLQKMIHQ HLSSRTHGSEDS | 4.036728475 | 3034 |
| IL-21_ 17259 | IL-21_ 5845 | N70G, K81D, R105E | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKEKPPSTNAGRRQKHRLTCPSC DSYEKKPPKEFLERFKSLLQKMIHQ HLSSRTHGSEDS | 4.044170164 | 3035 |
| IL-21_ 8427 | IL-21_ 4177 | H35I, Q41R, N70G, T110D, A112P | MRSSPGNMERIVICLMVIFLGTLVH KSSSQGQDRIMIRMRRLIDIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 4.057089258 | 3036 |
| IL-21_ 12826 | IL-21_ 0910 | R38E, I45T, K81D, V98E | MRSSPGNMERIVICLMVIFLGTLVH KSSSQGQDRHMIEMRQLIDTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 4.057254479 | 3037 |
| IL-21_ 14543 | IL-21_ 6018 | H35F, R38D, K81D, V98E, T110D | MRSSPGNMERIVICLMVIFLGTLVH KSSSQGQDRFMIDMRQLIDIVDQLK NYVNDLVPEFLPAPEDVETNCEWSA FSCFQDAQLKSANTGNNERIINESI KKLKRKPPSDNAGRRQKHRLTCPSC DSYEKKPPKEFLERFKSLLQKMIHQ HLSSRTHGSEDS | 4.058120175 | 3038 |
| IL-21_ 10657 | IL-21_ 3610 | R38E, P107V, R114Q, R115D | MRSSPGNMERIVICLMVIFLGTLVH KSSSQGQDRHMIEMRQLIDIVDQLK NYVNDLVPEFLPAPEDVETNCEWSA FSCFQKAQLKSANTGNNERIINVSI KKLKRKVPSTNAGQDQKHRLTCPSC DSYEKKPPKEFLERFKSLLQKMIHQ HLSSRTHGSEDS | 4.064375956 | 3039 |
| IL-21_ 8480 | IL-21_ 4177 | H35I, R38S, N70G, T110D, A112P | MRSSPGNMERIVICLMVIFLGTLVH KSSSQGQDRIMISMRQLIDIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 4.065786238 | 3040 |
| IL-21_ 7284 | IL-21_ 4177 | H35I, N70G, R105E, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKEKPPSDNPGRRQKHRLTCPSC DSYEKKPPKEFLERFKSLLQKMIHQ HLSSRTHGSEDS | 4.066663741 | 3041 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 20178 | IL-21_ 5474 | N70G, K81D, I100H, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSH KKLKRKPPSTNAGQDQKHRLTCPSC DSYEKKPPKEFLERFKSLLQKMIHQ HLSSRTHGSEDS | 4.070021509 | 3042 |
| IL-21_ 20113 | IL-21_ 5474 | N70G, K81D, 196R, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIRNVSI KKLKRKPPSTNAGQDQKHRLTCPSC DSYEKKPPKEFLERFKSLLQKMIHQ HLSSRTHGSEDS | 4.072042578 | 3043 |
| IL-21_ 16183 | IL-21_ 5845 | I45K, N70G, K81D | MRSSPGNMERIVICLMVIFLGTLVH KSSSQGQDRHMIRMRQLIDKVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 4.073006502 | 3044 |
| IL-21_ 17257 | IL-21_ 5845 | N70G, K81D, R105A | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKAKPPSTNAGRRQKHRLTCPSC DSYEKKPPKEFLERFKSLLQKMIHQ HLSSRTHGSEDS | 4.074023537 | 3045 |
| IL-21_ 8485 | IL-21_ 4177 | H35I, R38L, N70G, T110D, A112P | MRSSPGNMERIVICLMVIFLGTLVH KSSSQGQDRIMILMRQLIDIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 4.075129027 | 3046 |
| IL-21_ 11610 | IL-21_ 0910 | I45T, K81D, V98E, R105T | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KKLKTKPPSTNAGRRQKHRLTCPSC DSYEKKPPKEFLERFKSLLQKMIHQ HLSSRTHGSEDS | 4.075411528 | 3047 |
| IL-21_ 7281 | IL-21_ 4177 | H35I, N70G, R105H, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKHKPPSDNPGRRQKHRLTCPSC DSYEKKPPKEFLERFKSLLQKMIHQ HLSSRTHGSEDS | 4.079244581 | 3048 |
| IL-21_ 16064 | IL-21_ 5845 | R38S, N70G, K81D | MRSSPGNMERIVICLMVIFLGTLVH KSSSQGQDRHMISMRQLIDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 4.101457912 | 3049 |
| IL-21_ 17263 | IL-21_ 5845 | N70G, K81D, R105I | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKIKPPSTNAGRRQKHRLTCPSC DSYEKKPPKEFLERFKSLLQKMIHQ HLSSRTHGSEDS | 4.114072725 | 3050 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 12815 | IL-21_ 0910 | R38S, I45T, K81D, V98E | MRSSPGNMERIVICLMVIFLGTLVHKSSSQGQDRHMISMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 4.114600169 | 3051 |
| IL-21_ 11611 | IL-21_ 0910 | I45T, K81D, V98E, R105S | MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKSKPPSTNAGRRQKHRLTCPSCDSYEKKPPKEFLERFKSLLQKMIHQHLSSRTHGSEDS | 4.115980247 | 3052 |
| IL-21_ 10651 | IL-21_ 3610 | R38L, P107V, R114Q, R115D | MRSSPGNMERIVICLMVIFLGTLVHKSSSQGQDRHMILMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS | 4.125978963 | 3053 |
| IL-21_ 13056 | IL-21_ 6318 | H35F, R38V, K81D, V98E | MRSSPGNMERIVICLMVIFLGTLVHKSSSQGQDRFMIVMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 4.129523722 | 3054 |
| IL-21_ 14260 | IL-21_ 6318 | H35F, K81D, V98E, R105V | MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKVKPPSTNAGRRQKHRLTCPSCDSYEKKPPKEFLERFKSLLQKMIHQHLSSRTHGSEDS | 4.133518559 | 3055 |
| IL-21_ 7448 | IL-21_ 4177 | H35I, N70G, 196A, T110D, A112P | MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIANVSIKKLKRKPPSDNPGRRQKHRLTCPSCDSYEKKPPKEFLERFKSLLQKMIHQHLSSRTHGSEDS | 4.13362881 | 3056 |
| IL-21_ 12817 | IL-21_ 0910 | R38P, I45T, K81D, V98E | MRSSPGNMERIVICLMVIFLGTLVHKSSSQGQDRHMIPMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 4.135393327 | 3057 |
| IL-21_ 11607 | IL-21_ 0910 | I45T, K81D, V98E, R105Y | MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKYKPPSTNAGRRQKHRLTCPSCDSYEKKPPKEFLERFKSLLQKMIHQHLSSRTHGSEDS | 4.138645716 | 3058 |
| IL-21_ 13173 | IL-21_ 6318 | H35F, I45K, K81D, V98E | MRSSPGNMERIVICLMVIFLGTLVHKSSSQGQDRFMIRMRQLIDKVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS | 4.14296174 | 3059 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 9440 | IL-21_ 3610 | R105V, P107V, R114Q, R115D | MRSSPGNMERIVICLMVIFLGTLVH KSSSQGQDRHMIRMRQLIDIVDQLK NYVNDLVPEFLPAPEDVETNCEWSA FSCFQKAQLKSANTGNNERIINVSI KKLKVKVPSTNAGQDQKHRLTCPSC DSYEKKPPKEFLERFKSLLQKMIHQ HLSSRTHGSEDS | 4.14736135 | 3060 |
| IL-21_ 19740 | IL-21_ 5474 | N70G, A75Y, K81D, R114Q, R115D | MRSSPGNMERIVICLMVIFLGTLVH KSSSQGQDRHMIRMRQLIDIVDQLK NYVNDLVPEFLPAPEDVETGCEWSY FSCFQDAQLKSANTGNNERIINVSI KKLKRKPPSTNAGQDQKHRLTCPSC DSYEKKPPKEFLERFKSLLQKMIHQ HLSSRTHGSEDS | 4.154299485 | 3061 |
| IL-21_ 20229 | IL-21_ 5474 | N70G, K81D, L103E, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKEKRKPPSTNAGQDQKHRLTCPSC DSYEKKPPKEFLERFKSLLQKMIHQ HLSSRTHGSEDS | 4.155447488 | 3062 |
| IL-21_ 20265 | IL-21_ 5474 | N70G, K81D, R105E, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKEKPPSTNAGQDQKHRLTCPSC DSYEKKPPKEFLERFKSLLQKMIHQ HLSSRTHGSEDS | 4.165015394 | 3063 |
| IL-21_ 20238 | IL-21_ 5474 | N70G, K81D, L103Q, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKQKRKPPSTNAGQDQKHRLTCPSC DSYEKKPPKEFLERFKSLLQKMIHQ HLSSRTHGSEDS | 4.168505012 | 3064 |
| IL-21_ 12767 | IL-21_ 0910 | Q41K, I45T, K81D, V98E | MRSSPGNMERIVICLMVIFLGTLVH KSSSQGQDRHMIRMRKLIDTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 4.177367825 | 3065 |
| IL-21_ 8355 | IL-21_ 4177 | H351, I45R, N70G, T110D, A112P | MRSSPGNMERIVICLMVIFLGTLVH KSSSQGQDRIMIRMRQLIDRVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 4.177384607 | 3066 |
| IL-21_ 13179 | IL-21_ 6318 | H35F, I45R, K81D, V98E | MRSSPGNMERIVICLMVIFLGTLVH KSSSQGQDRFMIRMRQLIDRVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 4.177614169 | 3067 |
| IL-21_ 17264 | IL-21_ 5845 | N70G, K81D, R105K | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKKKPPSTNAGRRQKHRLTCPSC DSYEKKPPKEFLERFKSLLQKMIHQ HLSSRTHGSEDS | 4.190114758 | 3068 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 16117 | IL-21_ 5845 | Q41R, N70G, K81D | MRSSPGNMERIVICLMVIFLGTLVH KSSSQGQDRHMIRMRRLIDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 4.190188292 | 3069 |
| IL-21_ 9451 | IL-21_ 3610 | R105G, P107V, R114Q, R115D | MRSSPGNMERIVICLMVIFLGTLVH KSSSQGQDRHMIRMRQLIDIVDQLK NYVNDLVPEFLPAPEDVETNCEWSA FSCFQKAQLKSANTGNNERIINVSI KKLKGKVPSTNAGQDQKHRLTCPSC DSYEKKPPKEFLERFKSLLQKMIHQ HLSSRTHGSEDS | 4.191527254 | 3070 |
| IL-21_ 17258 | IL-21_ 5845 | N70G, K81D, R105D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKDKPPSTNAGRRQKHRLTCPSC DSYEKKPPKEFLERFKSLLQKMIHQ HLSSRTHGSEDS | 4.198670002 | 3071 |
| IL-21_ 11608 | IL-21_ 0910 | I45T, K81D, V98E, R105W | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KKLKWKPPSTNAGRRQKHRLTCPSC DSYEKKPPKEFLERFKSLLQKMIHQ HLSSRTHGSEDS | 4.200338495 | 3072 |
| IL-21_ 17107 | IL-21_ 5845 | N70G, K81D, 196Q | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIQNVSI KKLKRKPPSTNAGRRQKHRLTCPSC DSYEKKPPKEFLERFKSLLQKMIHQ HLSSRTHGSEDS | 4.200566734 | 3073 |
| IL-21_ 20232 | IL-21_ 5474 | N70G, K81D, L103H, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKHKRKPPSTNAGQDQKHRLTCPSC DSYEKKPPKEFLERFKSLLQKMIHQ HLSSRTHGSEDS | 4.203547217 | 3074 |
| IL-21_ 11620 | IL-21_ 0910 | I45T, K81D, V98E, R105G | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KKLKGKPPSTNAGRRQKHRLTCPSC DSYEKKPPKEFLERFKSLLQKMIHQ HLSSRTHGSEDS | 4.204363543 | 3075 |
| IL-21_ 20228 | IL-21_ 5474 | N70G, K81D, L103D, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKDKRKPPSTNAGQDQKHRLTCPSC DSYEKKPPKEFLERFKSLLQKMIHQ HLSSRTHGSEDS | 4.204639537 | 3076 |
| IL-21_ 16063 | IL-21_ 5845 | R38Q, N70G, K81D | MRSSPGNMERIVICLMVIFLGTLVH KSSSQGQDRHMIQMRQLIDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 4.207688247 | 3077 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 17565 | IL-21_ 5707 | R38P, K81D, V98E, P107V | MRSSPGNMERIVICLMVIFLGTLVHKSSSQGQDRHMIPMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS | 4.209429217 | 3078 |
| IL-21_ 17223 | IL-21_ 5845 | N70G, K81D, L103E | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKEKRKPPSTNAGRRQKHRLTCPSCDSYEKKPPKEFLERFKSLLQKMIHQHLSSRTHGSEDS | 4.211025302 | 3079 |
| IL-21_ 11618 | IL-21_ 0910 | I45T, K81D, V98E, R105I | MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKIKPPSTNAGRRQKHRLTCPSCDSYEKKPPKEFLERFKSLLQKMIHQHLSSRTHGSEDS | 4.215451309 | 3080 |
| IL-21_ 16061 | IL-21_ 5845 | R38N, N70G, K81D | MRSSPGNMERIVICLMVIFLGTLVHKSSSQGQDRHMINMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS | 4.22983306 | 3081 |
| IL-21_ 8489 | IL-21_ 4177 | H35I, R38G, N70G, T110D, A112P | MRSSPGNMERIVICLMVIFLGTLVHKSSSQGQDRIMIGMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS | 4.231177227 | 3082 |
| IL-21_ 11623 | IL-21_ 0910 | I45T, K81D, V98E, R105D | MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKDKPPSTNAGRRQKHRLTCPSCDSYEKKPPKEFLERFKSLLQKMIHQHLSSRTHGSEDS | 4.23182307 | 3083 |
| IL-21_ 17238 | IL-21_ 5845 | N70G, K81D, L103Y | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKYKRKPPSTNAGRRQKHRLTCPSCDSYEKKPPKEFLERFKSLLQKMIHQHLSSRTHGSEDS | 4.23411416 | 3084 |
| IL-21_ 20279 | IL-21_ 5474 | N70G, K81D, R105W, R114Q, R115D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKWKPPSTNAGQDQKHRLTCPSCDSYEKKPPKEFLERFKSLLQKMIHQHLSSRTHGSEDS | 4.241752224 | 3085 |
| IL-21_ 17267 | IL-21_ 5845 | N70G, K81D, R105N | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKNKPPSTNAGRRQKHRLTCPSCDSYEKKPPKEFLERFKSLLQKMIHQHLSSRTHGSEDS | 4.245169565 | 3086 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 16066 | IL-21_ 5845 | R38V, N70G, K81D | MRSSPGNMERIVICLMVIFLGTLVH KSSSQGQDRHMIVMRQLIDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 4.252938002 | 3087 |
| IL-21_ 16121 | IL-21_ 5845 | Q41W, N70G, K81D | MRSSPGNMERIVICLMVIFLGTLVH KSSSQGQDRHMIRMRWLIDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 4.254191642 | 3088 |
| IL-21_ 19865 | IL-21_ 5474 | N70G, K81D, A82W, R114Q, R115D | MRSSPGNMERIVICLMVIFLGTLVH KSSSQGQDRHMIRMRQLIDIVDQLK NYVNDLVPEFLPAPEDVETGCEWSA FSCFQDWQLKSANTGNNERIINVSI KKLKRKPPSTNAGQDQKHRLTCPSC DSYEKKPPKEFLERFKSLLQKMIHQ HLSSRTHGSEDS | 4.265503244 | 3089 |
| IL-21_ 17234 | IL-21_ 5845 | N70G, K81D, L103S | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKSKRKPPSTNAGRRQKHRLTCPSC DSYEKKPPKEFLERFKSLLQKMIHQ HLSSRTHGSEDS | 4.268598014 | 3090 |
| IL-21_ 20236 | IL-21_ 5474 | N70G, K81D, L103N, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKNKRKPPSTNAGQDQKHRLTCPSC DSYEKKPPKEFLERFKSLLQKMIHQ HLSSRTHGSEDS | 4.270428278 | 3091 |
| IL-21_ 17269 | IL-21_ 5845 | N70G, K81D, R105Q | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKQKPPSTNAGRRQKHRLTCPSC DSYEKKPPKEFLERFKSLLQKMIHQ HLSSRTHGSEDS | 4.270808621 | 3092 |
| IL-21_ 11613 | IL-21_ 0910 | I45T, K81D, V98E, R105P | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KKLKPKPPSTNAGRRQKHRLTCPSC DSYEKKPPKEFLERFKSLLQKMIHQ HLSSRTHGSEDS | 4.277723283 | 3093 |
| IL-21_ 15749 | IL-21_ 6018 | H35F, K81D, V98E, R105D, T110D | MRSSPGNMERIVICLMVIFLGTLVH KSSSQGQDRFMIRMRQLIDIVDQLK NYVNDLVPEFLPAPEDVETNCEWSA FSCFQDAQLKSANTGNNERIINESI KKLKDKPPSDNAGRRQKHRLTCPSC DSYEKKPPKEFLERFKSLLQKMIHQ HLSSRTHGSEDS | 4.28093546 | 3094 |
| IL-21_ 16059 | IL-21_ 5845 | R38L, N70G, K81D | MRSSPGNMERIVICLMVIFLGTLVH KSSSQGQDRHMILMRQLIDIVDQLK NYVNDLVPEFLPAPEDVETGCEWSA FSCFQDAQLKSANTGNNERIINVSI KKLKRKPPSTNAGRRQKHRLTCPSC DSYEKKPPKEFLERFKSLLQKMIHQ HLSSRTHGSEDS | 4.285445774 | 3095 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 19068 | IL-21_ 5474 | R38P, N70G, K81D, R114Q, R115D | MRSSPGNMERIVICLMVIFLGTLVH KSSSQGQDRHMIPMRQLIDIVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 4.297027381 | 3096 |
| IL-21_ 17273 | IL-21_ 5845 | N70G, K81D, R105W | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKWKPPSTNAGRRQKHRLTCPSC DSYEKKPPKEFLERFKSLLQKMIHQ HLSSRTHGSEDS | 4.299377658 | 3097 |
| IL-21_ 12819 | IL-21_ 0910 | R38M, I45T, K81D, V98E | MRSSPGNMERIVICLMVIFLGTLVH KSSSQGQDRHMIMMRQLIDTVDQLK NYVNDLVPEFLPAPEDVETNCEWSA FSCFQDAQLKSANTGNNERIINESI KKLKRKPPSTNAGRRQKHRLTCPSC DSYEKKPPKEFLERFKSLLQKMIHQ HLSSRTHGSEDS | 4.299696029 | 3098 |
| IL-21_ 7285 | IL-21_ 4177 | H35I, N70G, R105D, T110D, A112P | MRSSPGNMERIVICLMVIFLGTLVH KSSSQGQDRIMIRMRQLIDIVDQLK NYVNDLVPEFLPAPEDVETGCEWSA FSCFQKAQLKSANTGNNERIINVSI KKLKDKPPSDNPGRRQKHRLTCPSC DSYEKKPPKEFLERFKSLLQKMIHQ HLSSRTHGSEDS | 4.333413125 | 3099 |
| IL-21_ 11619 | IL-21_ 0910 | I45T, K81D, V98E, R105H | MRSSPGNMERIVICLMVIFLGTLVH KSSSQGQDRHMIRMRQLIDTVDQLK NYVNDLVPEFLPAPEDVETNCEWSA FSCFQDAQLKSANTGNNERIINESI KKLKHKPPSTNAGRRQKHRLTCPSC DSYEKKPPKEFLERFKSLLQKMIHQ HLSSRTHGSEDS | 4.343984569 | 3100 |
| IL-21_ 17272 | IL-21_ 5845 | N70G, K81D, R105V | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKVKPPSTNAGRRQKHRLTCPSC DSYEKKPPKEFLERFKSLLQKMIHQ HLSSRTHGSEDS | 4.347945466 | 3101 |
| IL-21_ 18769 | IL-21_ 5707 | K81D, V98E, R105P, P107V | MRSSPGNMERIVICLMVIFLGTLVH KSSSQGQDRHMIRMRQLIDIVDQLK NYVNDLVPEFLPAPEDVETNCEWSA FSCFQDAQLKSANTGNNERIINESI KKLKPKVPSTNAGRRQKHRLTCPSC DSYEKKPPKEFLERFKSLLQKMIHQ HLSSRTHGSEDS | 4.349901067 | 3102 |
| IL-21_ 20277 | IL-21_ 5474 | N70G, K81D, R105T, R114Q, R115D | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIINVSI KKLKTKPPSTNAGQDQKHRLTCPSC DSYEKKPPKEFLERFKSLLQKMIHQ HLSSRTHGSEDS | 4.357966217 | 3103 |
| IL-21_ 9454 | IL-21_ 3610 | R105D, P107V, R114Q, R115D | MRSSPGNMERIVICLMVIFLGTLVH KSSSQGQDRHMIRMRQLIDIVDQLK NYVNDLVPEFLPAPEDVETNCEWSA FSCFQKAQLKSANTGNNERIINVSI KKLKDKVPSTNAGQDQKHRLTCPSC DSYEKKPPKEFLERFKSLLQKMIHQ HLSSRTHGSEDS | 4.369748312 | 3104 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 14544 | IL-21_ 6018 | H35F, R38E, K81D, V98E, T110D | MRSSPGNMERIVICLMVIFLGTLVHKSSSQGQDRFMIEMRQLIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS | 4.374510525 | 3105 |
| IL-21_ 17262 | IL-21_ 5845 | N70G, K81D, R105H | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKHKPPSTNAGRRQKHRLTCPSCDSYEKKPPKEFLERFKSLLQKMIHQHLSSRTHGSEDS | 4.382828635 | 3106 |
| IL-21_ 7447 | IL-21_ 4177 | H35I, N70G, 196D, T110D, A112P | MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIDNVSIKKLKRKPPSDNPGRRQKHRLTCPSCDSYEKKPPKEFLERFKSLLQKMIHQHLSSRTHGSEDS | 4.402751804 | 3107 |
| IL-21_ 17270 | IL-21_ 5845 | N70G, K81D, R105S | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKSKPPSTNAGRRQKHRLTCPSCDSYEKKPPKEFLERFKSLLQKMIHQHLSSRTHGSEDS | 4.440190316 | 3108 |
| IL-21_ 7674 | IL-21_ 4177 | H35I, N70G, Q83L, T110D, A112P | MRSSPGNMERIVICLMVIFLGTLVHKSSSQGQDRIMIRMRQLIDIVDQLKNYVNDLVPEFLPAPEDVETGCEWSAFSCFQKALLKSANTGNNERIINVSIKKLKRKPPSDNPGRRQKHRLTCPSCDSYEKKPPKEFLERFKSLLQKMIHQHLSSRTHGSEDS | 4.447511588 | 3109 |
| IL-21_ 7270 | IL-21_ 4177 | H35I, N70G, R105W, T110D, A112P | MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKWKPPSDNPGRRQKHRLTCPSCDSYEKKPPKEFLERFKSLLQKMIHQHLSSRTHGSEDS | 4.453942703 | 3110 |
| IL-21_ 8487 | IL-21_ 4177 | H35I, R38I, N70G, T110D, A112P | MRSSPGNMERIVICLMVIFLGTLVHKSSSQGQDRIMIIMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS | 4.465446324 | 3111 |
| IL-21_ 20107 | IL-21_ 5474 | N70G, K81D, 196K, R114Q, R115D | MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIKNVSIKKLKRKPPSTNAGQDQKHRLTCPSCDSYEKKPPKEFLERFKSLLQKMIHQHLSSRTHGSEDS | 4.500922798 | 3112 |
| IL-21_ 11609 | IL-21_ 0910 | I45T, K81D, V98E, R105V | MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKVKPPSTNAGRRQKHRLTCPSCDSYEKKPPKEFLERFKSLLQKMIHQHLSSRTHGSEDS | 4.510978155 | 3113 |

TABLE 13-continued

Detuned IL-21 Variants Identified from Eight Stabilized Parental IL-21 Sequences

| var_id | parent | mutations | Full_aa_ seq | Predicted affinity | SEQ ID NO |
|---|---|---|---|---|---|
| IL-21_ 8482 | IL-21_ 4177 | H35I, R38P, N70G, T110D, A112P | MRSSPGNMERIVICLMVIFLGTLVH KSSSQGQDRIMIPMRQLIDIVDQLK NYVNDLVPEFLPAPEDVETGCEWSA FSCFQKAQLKSANTGNNERIINVSI KKLKRKPPSDNPGRRQKHRLTCPSC DSYEKKPPKEFLERFKSLLQKMIHQ HLSSRTHGSEDS | 4.530671298 | 3114 |
| IL-21_ 10653 | IL-21_ 3610 | R38I, P107V, R114Q, R115D | MRSSPGNMERIVICLMVIFLGTLVH KSSSQGQDRHMIIMRQLIDIVDQLK NYVNDLVPEFLPAPEDVETNCEWSA FSCFQKAQLKSANTGNNERIINVSI KKLKRKVPSTNAGQDQKHRLTCPSC DSYEKKPPKEFLERFKSLLQKMIHQ HLSSRTHGSEDS | 4.534231146 | 3115 |
| IL-21_ 17101 | IL-21_ 5845 | N70G, K81D, 196H | MRSSPGNMERIVICLMVIFLGTLVH KSSSQGQDRHMIRMRQLIDIVDQLK NYVNDLVPEFLPAPEDVETGCEWSA FSCFQDAQLKSANTGNNERIHNVSI KKLKRKPPSTNAGRRQKHRLTCPSC DSYEKKPPKEFLERFKSLLQKMIHQ HLSSRTHGSEDS | 4.56820794 | 3116 |
| IL-21_ 19059 | IL-21_ 5474 | R38E, N70G, K81D, R114Q, R115D | MRSSPGNMERIVICLMVIFLGTLVH KSSSQGQDRHMIEMRQLIDIVDQLK NYVNDLVPEFLPAPEDVETGCEWSA FSCFQDAQLKSANTGNNERIINVSI KKLKRKPPSTNAGQDQKHRLTCPSC DSYEKKPPKEFLERFKSLLQKMIHQ HLSSRTHGSEDS | 5.072531317 | 3117 |

Example 6: Efficacy Modeling for IL-21v-Anti-CD8 Fusions

To demonstrate the therapeutic effect of delivering detuned, stabilized IL-21 molecules to cytotoxic T cells, a surrogate detuned mouse IL-21 molecule fused to an anti-mouse-CD8 antibody was tested in a syngeneic mouse tumor growth inhibition study. MC38 colon adenocarcinoma cells were subcutaneously implanted in the flank of C57BL/6 mice. Implanted tumors were grown to approximate mean tumor volumes of 80 $mm^3$, as determined by caliper measurement and calculated as L×W×H/2. Non-outlier, tumor bearing mice were randomized into treatment groups consisting of 10 mice per group on D0, and immunocytokine or vehicle test agents were dosed intravenously. Body weights and tumor volume measurements were performed three times a week throughout the duration of the study. Mice received 5 mg/kg of test agent or vehicle control on D0, D7, and D14. Mice were taken off study when tumor volumes exceeded 2000 $mm^3$, lost more than 20% body weight or tumors became ulcerated. In some instances, mice were found dead from tumor or toxicity complications.

Figure 18:
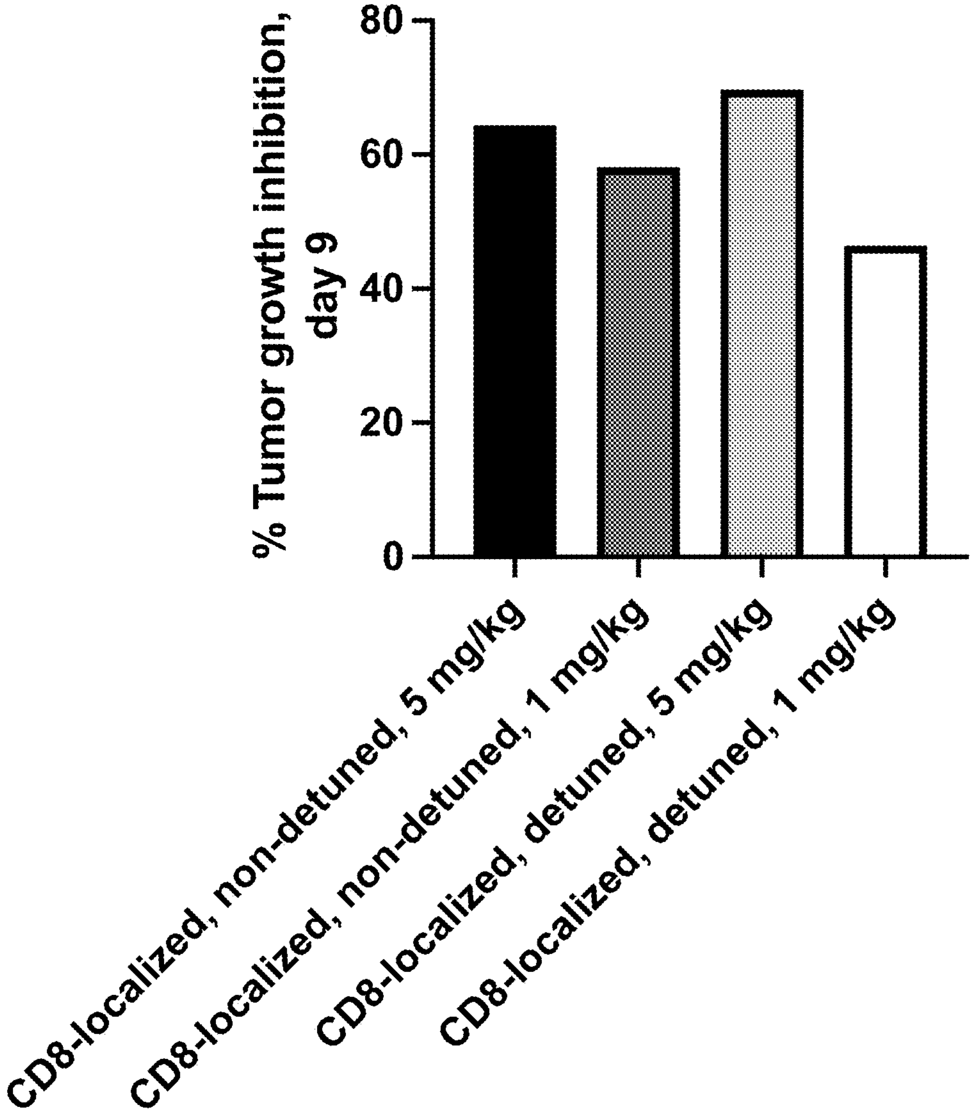
FIG. 18 is a bar plot showing % tumor growth inhibition for CD8-localized IL-21 molecules tested in an MC38 tumor model. % tumor growth inhibition was calculated using the formula (1−(mean tumor volume treatment group/mean tumor volume control group))*100 on the last day in which all vehicle control mice were on study (day 9). N=10 mice per group.
Figure 19:
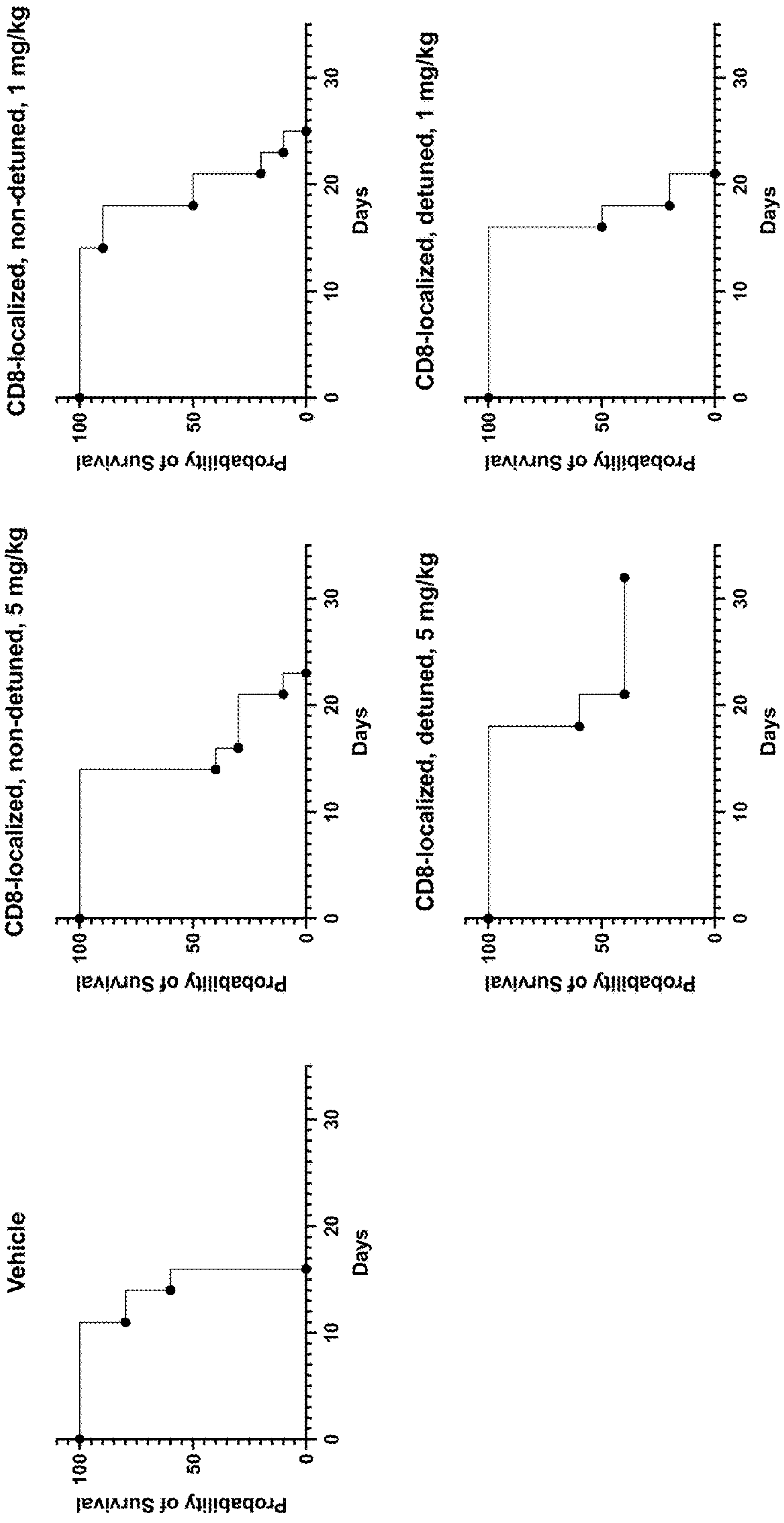
FIG. 19 shows survival curves for control and treatment groups in an MC38 tumor model study. Data is shown through day 32 of the study. N=10 mice per group.

On study day 9, the first mouse in the vehicle treatment group was taken off study and tumor growth inhibition was calculated as (1−(mean tumor volume treatment group/mean tumor volume control group))*100. As shown in FIG. 18, the anti-CD8 localized detuned IL-21 showed similar tumor growth inhibition as anti-CD8 localized stabilized, non-detuned IL-21 cytokine. However, mice treated with the anti-CD8 targeted non-detuned cytokine experienced lethal toxicity in the 24 hours following the third dose (D14), shown in the survival curves in FIG. 19. In contrast, none of the mice treated with anti-CD8 targeted detuned IL-21 exhibited toxicity or needed to be taken off study at that time. These results demonstrate detuned CD8-localized IL-21 elicited increased tumor growth inhibition with a wider therapeutic index compared to the similarly formatted and localized version of the non-detuned IL-21 cytokine.

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (3121 sequences)

SEQ ID NO: 1 - protein, 162 aa, Homo sapiens
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 2 - protein, 538 aa, Homo sapiens
MPRGWAAPLLLLLLQGGWGCPDLVCYTDYLQTVICILEMWNLHPSTLTLTWQDQYEELKDEATSCSLHRSAHNATHATYTCHMDVFHFMADDIFSVNITDQSGNYSQECGSFLLAESIKPAPPFNVTVTFSGQYNISWRSDYEDPAFYMLKGKLQYELQYRNRGDPWAVSPRRKLISVDSRSVSLLPLEFRKDSSYELQVRAGPMPGSSYQGTWSEWSDPVIFQTQSEELKEGWNPHLLLLLLLVIVFIPAFWSLKTHPLWRLWKKIWAVPSPERFFMPLYKGCSGDFKKWVGAPFTGSSLELGPWSPEVPSTLEVYSCHPPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 3 - protein, 146 aa, Mus musculus [sequence omitted]

SEQ ID NO: 4 - protein, 529 aa, Mus musculus
MPRGPVAALLLLILHGAWSCLDLTCYTDYLWTITCVLETRSPNPSILSLTWQDEYEELQDQETFCSLHRSGHNTTHIWYTCHMRLSQFLSDEVFIVNVTDQSGNNSQECGSFVLAESIKPAPPLNVTVAFSGRYDISWDSAYDEPSNYVLRGKLQYELQYRNLRDPYAVRPVTKLISVDSRNVSLLPEEFHKDSSYQLQVRAAPQPGTSFRGTWSEWSDPVIFQTQAGEPEAGWDPHMLLLLAVLIIVLVFMGLKIHLPWRLWKKIWAPVPTPESFFQPLYREHSGNFKKWVNTPFTASSIELVPQSSTTTSALHLSLYPAKEKKFPGLPGLEEQLECDGMSEPGHWCIIPLAAGQAVSAYSEERDRPYGLVSIDTVTVGDAEGLCVWPCSCEDDGYPAMNLDAGRESGPNSEDLLLVTDPAFLSCGCVSGSGLRLGGSPGSLLDRLRLSFAKEGDWTADPTWRTGSPGGGSESEAGSPPGLDMDTFDSGFAGSDCGSPVETDEGPPRSYLRQWVVRTPPPVDSGAQSS

SEQ ID NO: 5 - protein, 118 aa, synthetic construct
EVQLVESGGGLVQPGGSLRLSCAASGFNIKDTYIHFVRQAPGKGLEWIGRIDPANDNTLYASKFQGKATISADTSKNTAYLQMNSLRAEDTAVYYCGRGYGYYVFDHWGQGTLVTVSS

SEQ ID NO: 6 - protein, 107 aa, synthetic construct
DVQITQSPSSLSASVGDRVTITCRTSRSISQYLAWYQQKPGKVPKLLIYSGSTLQSGVPSRFSGSGSGTDFTLTISSLQPEDVATYYCQQHNENPLTFGGGTKVEIK

SEQ ID NO: 7 - protein, 119 aa, synthetic construct
EVQLVQSGAEVKKPGSSVKVSCKASGYTFSSYVMHWVRQAPGQGLEWIGYIDPYNDGAKYAQKFQGRVTLTSDKSTSTAYMELSSLRSEDTAVYYCARGGPYGWYFDVWGQGTTVTVSS

SEQ ID NO: 8 - protein, 107 aa, synthetic construct
DIQMTQSPSSLSASVGDRVTITCRASEHIYSYLSWYQQKPGKVPKLLIYNAKTLAEGVPSRFSGSGSGTDFTLTISSLQPEDVATYYCQHHFGSPLTFGQGTRLEIK

SEQ ID NO: 9 - protein, 119 aa, synthetic construct
QVQLVQSGAEVKKPGASVKLSCKASGYNFKHTYAHWVRQAPGQGLEWIGRIDPANGNTKYDPKFQGRATMTADTASNTAYLELSSLRSEDTAVYYCVADHYGSSLLDYWGQGTLVTVSS

SEQ ID NO: 10 - protein, 112 aa, synthetic construct
DVVMTQTPLSLSVTPGQPASISCKSSQSLLDSDGKTYLNWFQQRPGQSPRRLIYLVSKLDSGVPDRFSGSGSGTDFTLKISRVEAEDVGVYYCWQGTYFPYTFGQGTKLEIK

SEQ ID NO: 11 - protein, 116 aa, synthetic construct
QVQLVQSGAEVKKPGSSVKVSCKASGYTFTSYRMHWVRQAPGQGLEWIGYINPSTGYTEYNQKFKDKATITADESTNTAYMELSSLRSEDTAVYYCARGGGVFDYWGQGTLVTVSS

SEQ ID NO: 12 - protein, 106 aa, synthetic construct
DIQMTQSPSTLSASVGDRVTITCSASSSISYMHWYQQKPGKAPKLLIYTTSNLASGVPARFSGSGSGTEFTLTISSLQPDDFATYYCHQRSTYPLTFGQGTKVEVK

SEQ ID NO: 13 - protein, 115 aa, synthetic construct
QLQQSGTVLARPGASVKMSCKASGYSFTRYWMHWIKQRPGQGLEWIGAIYPGNSDTSYNQKFEGKAKLTAVTSASTAYMELSSLTHEDSAVYYCSRDYGYYFDFWGQGTTLTVSS

SEQ ID NO: 14 - protein, 104 aa, synthetic construct [sequence omitted]

SEQ ID NO: 15 - protein, 162 aa, synthetic construct
MRSSPGNMERIVICLMVIFLGTLVHKSSSQGQDRHMIRMRQLIDIVDQLKNDVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 16 - protein, 162 aa, synthetic construct
MRSSPGNMERIVICLMVIFLGTLVHKSSSQGQDRHMIRMRQLIDIQDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 17 - protein, 162 aa, synthetic construct
MRSSPGNMERIVICLMVIFLGTLVHKSSSQGQDRHMIRMRQLIDIVDQLKNYVNDLVPEFLPAPEDVETNCEKSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 18 - protein, 162 aa, synthetic construct
MRSSPGNMERIVICLMVIFLGTLVHKSSSQGQDRHMIRKRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 19 - protein, 162 aa, synthetic construct
MRSSPGNMERIVICLMVIFLGTLVHKSSSQGQDRHMIRDRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 20 - protein, 162 aa, synthetic construct
MRSSPGNMERIVICLMVIFLGTLVHKSSSQGQDRHMIRMRQLIDIVDQLKNYVNDLVPEFLPAPEDVETNCEWSNFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 21 - protein, 162 aa, synthetic construct
MRSSPGNMERIVICLMVIFLGTLVHKSSSQGQDRHMIRMRQLIDIKDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 22 - protein, 162 aa, synthetic construct
MRSSPGNMERIVICLMVIFLGTLVHKSSSQGQDRHMIRMRQLIDIVDQLKNYVNDSVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 23 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFDKAQLKSANTGNNERIINVSIKKLKRKPPSTNAGRRQKHRLTCPSCDSYEKKPPKEFLERFKSLLQKMIHQHLSSRTHGSEDS

SEQ ID NO: 24 - protein, 162 aa, synthetic construct
MRSSPGNMERIVICLMVIFLGTLVHKSSSQGQDRHMIRMRQLIDITDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 25 - protein, 162 aa, synthetic construct
MRSSPGNMERIVICLMVIFLGTLVHKSSSQGQDRHMIRMRQLIDIVDQLKNYVNDLHPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 26 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAQSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 27 - protein, 162 aa, synthetic construct
MRSSPGNMERIVICLMVIFLGTLVHKSSSQGQDRHMIRQRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 28 - protein, 162 aa, synthetic construct
MRSSPGNMERIVICLMVIFLGTLVHKSSSQGQDRHMIRMRQLIPIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 29 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKEKRKPPSTNAGRRQKHRLTCPSCDSYEKKPPKEFLERFKSLLQKMIHQHLSSRTHGSEDS

SEQ ID NO: 30 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIDNVSIKKLKRKPPSTNAGRRQKHRLTCPSCDSYEKKPPKEFLERFKSLLQKMIHQHLSSRTHGSEDS

SEQ ID NO: 31 - protein, 162 aa, synthetic construct
MRSSPGNMERIVICLMVIFLGTLVHKSSSQGQDRHMIRMRQLIDIVDQLKNYNNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 32 - protein, 162 aa, synthetic construct
MRSSPGNMERIVICLMVIFLGTLVHKSSSQGQDRHMIRMRQHIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 33 - protein, 162 aa, synthetic construct
MRSSPGNMERIVICLMVIFLGTLVHKSSSQGQDRHMIRMRQLIDIVDQEKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 34 - protein, 162 aa, synthetic construct
MRSSPGNMERIVICLMVIFLGTLVHKSSSQGQDRHMIRMRQLIDIVPQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 35 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSEKKLKRKPPSTNAGRRQKHRLTCPSCDSYEKKPPKEFLERFKSLLQKMIHQHLSSRTHGSEDS

SEQ ID NO: 36 - protein, 162 aa, synthetic construct
MRSSPGNMERIVICLMVIFLGTLVHKSSSQGQDRHMIRMRQLIDINDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 37 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKQKPPSTNAGRRQKHRLTCPSCDSYEKKPPKEFLERFKSLLQKMIHQHLSSRTHGSEDS

SEQ ID NO: 38 - protein, 162 aa, synthetic construct
MRSSPGNMERIVICLMVIFLGTLVHKSSSQGQDRHMIRMRQLIDIGDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 39 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAPSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 40 - protein, 162 aa, synthetic construct
MRSSPGNMERIVICLMVIFLGTLVHKSSSQGQDRHMIRMRQLIDIVDQLKNYVNDLVPEFLPAPEDVETNCEVSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 41 - protein, 162 aa, synthetic construct
MRSSPGNMERIVICLMVIFLGTLVHKSSSQGQDRHMIRMRQLPDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 42 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFAKAQLKSANTGNNERIINVSIKKLKRKPPSTNAGRRQKHRLTCPSCDSYEKKPPKEFLERFKSLLQKMIHQHLSSRTHGSEDS

SEQ ID NO: 43 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKDKPPSTNAGRRQKHRLTCPSCDSYEKKPPKEFLERFKSLLQKMIHQHLSSRTHGSEDS

SEQ ID NO: 44 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAHSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 45 - protein, 162 aa, synthetic construct
MRSSPGNMERIVICLMVIFLGTLVHKSSSQGQDRHMIRMRQEIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 46 - protein, 162 aa, synthetic construct
MRSSPGNMERIVICLMVIFLGTLVHKSSSQGQDRHMIRMRQLIDIVDQLKNYVNDLVPEFLPAPEDVETNCETSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 47 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCPQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 48 - protein, 162 aa, synthetic construct
MRSSPGNMERIVICLMVIFLGTLVHKSSSQGQDRHMIRMRQGIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 49 - protein, 162 aa, synthetic construct
MRSSPGNMERIVICLMVIFLGTLVHKSSSQGQDRHMIRMRQLDDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 50 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPTSTNAGRRQKHRLTCPSCDSYEKKPPKEFLERFKSLLQKMIHQHLSSRTHGSEDS

SEQ ID NO: 51 - protein, 162 aa, synthetic construct
MRSSPGNMERIVICLMVIFLGTLVHKSSSQGQDRHMIRMRKLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 52 - protein, 162 aa, synthetic construct
MRSSPGNMERIVICLMVIFLGTLVHKSSSQGQDRHMIRMRQLIDIVDQHKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 53 - protein, 162 aa, synthetic construct
MRSSPGNMERIVICLMVIFLGTLVHKSSSQGQDRHMIRMRQLIDIVDQLKNYVNDLVPEFLPAPEDVETNCEWSARSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 54 - protein, 162 aa, synthetic construct
MRSSPGNMERIVICLMVIFLGTLVHKSSSQGQDRHMIRMRQLIDIEDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 55 - protein, 162 aa, synthetic construct
MRSSPGNMERIVICLMVIFLGTLVHKSSSQGQDRHMIVMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 56 - protein, 162 aa, synthetic construct
MRSSPGNMERIVICLMVIFLGTLVHKSSSQGQDRHMIRMRQLIDIVDQDKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 57 - protein, 162 aa, synthetic construct
MRSSPGNMERIVICLMVIFLGTLVHKSSSQGQDRHMIRMRQLIDIVDQLKNYVNDLVPEFLPAPEDVETNCEWSADSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 58 - protein, 162 aa, synthetic construct
MRSSPGNMERIVICLMVIFLGTLVHKSSSQGQDRHMIRMRQLIDIVDQLKNYVNDLVPEFLPAPEDVETNCESSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 59 - protein, 162 aa, synthetic construct
MRSSPGNMERIVICLMVIFLGTLVHKSSSQGQDRHMIRMRQLIDIVDQLKNYVNDLPPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 60 - protein, 162 aa, synthetic construct
MRSSPGNMERIVICLMVIFLGTLVHKSSSQGQDRHMIRRRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 61 - protein, 162 aa, synthetic construct
MRSSPGNMERIVICLMVIFLGTLVHKSSSQGQDRHMIRMRQLIDIVDQLKNKVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 62 - protein, 162 aa, synthetic construct
MRSSPGNMERIVICLMVIFLGTLVHKSSSQGQDRHMIRMRQLIDIVDQLKNYVNDLVPEFLPAPEDVETNCEWSATSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 63 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCYQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 64 - protein, 162 aa, synthetic construct
MRSSPGNMERIVICLMVIFLGTLVHKSSSQGQDRHMIRERQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 65 - protein, 162 aa, synthetic construct
MRSSPGNMERIVICLMVIFLGTLVHKSSSQGQDRHMIRMRQLIDGVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 66 - protein, 162 aa, synthetic construct
MRSSPGNMERIVICLMVIFLGTLVHKSSSQGQDRHMIRMRQLIDIVSQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 67 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCKQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 68 - protein, 162 aa, synthetic construct
MRSSPGNMERIVICLMVIFLGTLVHKSSSQGQDRHMIRMRQLIDIVDQKKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 69 - protein, 162 aa, synthetic construct
MRSSPGNMERIVICLMVIFLGTLVHKSSSQGQDRHMIRMRQQIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 70 - protein, 162 aa, synthetic construct
MRSSPGNMERIVICLMVIFLGTLVHKSSSQGQDRHMIRMRQLIDHVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 71 - protein, 162 aa, synthetic construct
MRSSPGNMERIVICLMVIFLGTLVHKSSSQGQDRHMIRMRQLIDIVDQNKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 72 - protein, 162 aa, synthetic construct
MRSSPGNMERIVICLMVIFLGTLVHKSSSQGQDRHMIRMRQLIDRVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 73 - protein, 162 aa, synthetic construct
MRSSPGNMERIVICLMVIFLGTLVHKSSSQGQDRHMRRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 74 - protein, 162 aa, synthetic construct
MRSSPGNMERIVICLMVIFLGTLVHKSSSQGQDRHMIRMRQNIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 75 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKSKPPSTNAGRRQKHRLTCPSCDSYEKKPPKEFLERFKSLLQKMIHQHLSSRTHGSEDS

SEQ ID NO: 76 - protein, 162 aa, synthetic construct
MRSSPGNMERIVICLMVIFLGTLVHKSSSQGQDRHMIRMRQLSDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 77 - protein, 162 aa, synthetic construct
MRSSPGNMERIVICLMVIFLGTLVHKSSSQGQDRHMIRMRQLIDIVDQPKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 78 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERPINVSIKKLKRKPPSTNAGRRQKHRLTCPSCDSYEKKPPKEFLERFKSLLQKMIHQHLSSRTHGSEDS

SEQ ID NO: 79 - protein, 162 aa, synthetic construct
MRSSPGNMERIVICLMVIFLGTLVHKSSSQGQDRHMIAMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 80 - protein, 162 aa, synthetic construct
MRSSPGNMERIVICLMVIFLGTLVHKSSSQGQDRHMIRMRQLIDSVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 81 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKWKPPSTNAGRRQKHRLTCPSCDSYEKKPPKEFLERFKSLLQKMIHQHLSSRTHGSEDS

SEQ ID NO: 82 - protein, 162 aa, synthetic construct
MRSSPGNMERIVICLMVIFLGTLVHKSSSQGQDRHMIRMRQLIDIPDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 83 - protein, 162 aa, synthetic construct
MRSSPGNMERIVICLMVIFLGTLVHKSSSQGQDRHMIRMRQLIDYVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 84 - protein, 162 aa, synthetic construct
MRSSPGNMERIVICLMVIFLGTLVHKSSSQGQDRHMIQMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 85 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIPNVSIKKLKRKPPSTNAGRRQKHRLTCPSCDSYEKKPPKEFLERFKSLLQKMIHQHLSSRTHGSEDS

SEQ ID NO: 86 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAESCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 87 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 88 - protein, 162 aa, synthetic construct
MRSSPGNMERIVICLMVIFLGTLVHKSSSQGQDRHMIRMRQLIDIDDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 89 - protein, 162 aa, synthetic construct
MRSSPGNMERIVICLMVIFLGTLVHKSSSQGQDRHMIRMRQLIDIVDQLKNYPNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 90 - protein, 162 aa, synthetic construct
MRSSPGNMERIVICLMVIFLGTLVHKSSSQGQDRHMIRPRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 91 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERKINVSIKKLKRKPPSTNAGRRQKHRLTCPSCDSYEKKPPKEFLERFKSLLQKMIHQHLSSRTHGSEDS

SEQ ID NO: 92 - protein, 162 aa, synthetic construct
MRSSPGNMERIVICLMVIFLGTLVHKSSSQGQDRHMIRMRQKIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 93 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKKKPPSTNAGRRQKHRLTCPSCDSYEKKPPKEFLERFKSLLQKMIHQHLSSRTHGSEDS

SEQ ID NO: 94 - protein, 162 aa, synthetic construct
MRSSPGNMERIVICLMVIFLGTLVHKSSSQGQDRHMIKMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 95 - protein, 162 aa, synthetic construct
MRSSPGNMERIVICLMVIFLGTLVHKSSSQGQDRHMIRGRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 96 - protein, 162 aa, synthetic construct
MRSSPGNMERIVICLMVIFLGTLVHKSSSQGQDRHMIRMRQLIDIVDQLKNYVNDFVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 97 - protein, 162 aa, synthetic construct
MRSSPGNMERIVICLMVIFLGTLVHKSSSQGQDRHMSRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 98 - protein, 162 aa, synthetic construct
MRSSPGNMERIVICLMVIFLGTLVHKSSSQGQDRHMIRMRQLIAIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 99 - protein, 162 aa, synthetic construct
MRSSPGNMERIVICLMVIFLGTLVHKSSSQGQDRHMNRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 100 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERITNVSIKKLKRKPPSTNAGRRQKHRLTCPSCDSYEKKPPKEFLERFKSLLQKMIHQHLSSRTHGSEDS

SEQ ID NO: 101 - protein, 162 aa, synthetic construct
MRSSPGNMERIVICLMVIFLGTLVHKSSSQGQDRHMIRMRQLIDIVDQLKNYVNDNVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 102 - protein, 162 aa, synthetic construct
MRSSPGNMERIVICLMVIFLGTLVHKSSSQGQDRHMIRMRQLIDPVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 103 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIGNVSIKKLKRKPPSTNAGRRQKHRLTCPSCDSYEKKPPKEFLERFKSLLQKMIHQHLSSRTHGSEDS

SEQ ID NO: 104 - protein, 162 aa, synthetic construct
MRSSPGNMERIVICLMVIFLGTLVHKSSSQGQDRHMIRMRQLIDIVDQLKNYVNDLVPRFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 105 - protein, 162 aa, synthetic construct
MRSSPGNMERIVICLMVIFLGTLVHKSSSQGQDRHMIRMRPLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 106 - protein, 162 aa, synthetic construct
MRSSPGNMERIVICLMVIFLGTLVHKSSSQGQDRHMIRMRQLIDDVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 107 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPQSTNAGRRQKHRLTCPSCDSYEKKPPKEFLERFKSLLQKMIHQHLSSRTHGSEDS

SEQ ID NO: 108 - protein, 162 aa, synthetic construct
MRSSPGNMERIVICLMVIFLGTLVHKSSSQGQDRHMIRMRQLIDIVDQSKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 109 - protein, 162 aa, synthetic construct
MRSSPGNMERIVICLMVIFLGTLVHKSSSQGQDRHMIRMRQDIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 110 - protein, 162 aa, synthetic construct
MRSSPGNMERIVICLMVIFLGTLVHKSSSQGQDRHMIRMRQSIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 111 - protein, 162 aa, synthetic construct
MRSSPGNMERIVICLMVIFLGTLVHKSSSQGQDRHMIRMRQLIDIVDKLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 112 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCTQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 113 - protein, 162 aa, synthetic construct
MRSSPGNMERIVICLMVIFLGTLVHKSSSQGQDRHMIRMRQLIDNVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 114 - protein, 162 aa, synthetic construct
MRSSPGNMERIVICLMVIFLGTLVHKSSSQGQDRHMIRMRQLIDIVDQLKNYVNDLVPEFLPAPEDVETNCEPSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 115 - protein, 162 aa, synthetic construct
MRSSPGNMERIVICLMVIFLGTLVHKSSSQGQDRHMIRMRQLIGIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 116 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRVTCPSCDSYEKKPPKEFLERFKSLLQKMIHQHLSSRTHGSEDS

SEQ ID NO: 117 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMSHQHLSSRTHGSEDS

SEQ ID NO: 118 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCDQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 119 - protein, 162 aa, synthetic construct
MRSSPGNMERIVICLMVIFLGTLVHKSSSQGQDRHMGRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 120 - protein, 162 aa, synthetic construct
MRSSPGNMERIVICLMVIFLGTLVHKSSSQGQDRHMIRMRQLIDIVDQRKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 121 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIANVSIKKLKRKPPSTNAGRRQKHRLTCPSCDSYEKKPPKEFLERFKSLLQKMIHQHLSSRTHGSEDS

SEQ ID NO: 122 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERHINVSIKKLKRKPPSTNAGRRQKHRLTCPSCDSYEKKPPKEFLERFKSLLQKMIHQHLSSRTHGSEDS

SEQ ID NO: 123 - protein, 162 aa, synthetic construct
MRSSPGNMERIVICLMVIFLGTLVHKSSSQGQDRHMIRMRQLIDIVDQLKNYVNDLVPEFLPAPEDVETNCEGSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 124 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINKSIKKLKRKPPSTNAGRRQKHRLTCPSCDSYEKKPPKEFLERFKSLLQKMIHQHLSSRTHGSEDS

SEQ ID NO: 125 - protein, 162 aa, synthetic construct
MRSSPGNMERIVICLMVIFLGTLVHKSSSQGQDRHMIRMRQLIDIVDQLKNYQNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 126 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPGSTNAGRRQKHRLTCPSCDSYEKKPPKEFLERFKSLLQKMIHQHLSSRTHGSEDS

SEQ ID NO: 127 - protein, 162 aa, synthetic construct
MRSSPGNMERIVICLMVIFLGTLVHKSSSQGQPRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 128 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCRQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 129 - protein, 162 aa, synthetic construct
MRSSPGNMERIVICLMVIFLGTLVHKSSSQGQDRHMIRMRQLIDIVDQLKNYVNDLVPEFLPAPEDVETNCENSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 130 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERISNVSIKKLKRKPPSTNAGRRQKHRLTCPSCDSYEKKPPKEFLERFKSLLQKMIHQHLSSRTHGSEDS

SEQ ID NO: 131 - protein, 162 aa, synthetic construct
MRSSPGNMERIVICLMVIFLGTLVHKSSSQGQDRHMIMMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 132 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINRSIKKLKRKPPSTNAGRRQKHRLTCPSCDSYEKKPPKEFLERFKSLLQKMIHQHLSSRTHGSEDS

SEQ ID NO: 133 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKAPKEFLERFKSLLQKMIHQHLSSRTHGSEDS

SEQ ID NO: 134 - protein, 162 aa, synthetic construct
MRSSPGNMERIVICLMVIFLGTLVHKSSSQGQDRHMIRMRQRIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 135 - protein, 162 aa, synthetic construct
MRSSPGNMERIVICLMVIFLGTLVHKSSSQGQRRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 136 - protein, 162 aa, synthetic construct
MRSSPGNMERIVICLMVIFLGTLVHKSSSQGQDRHMIRMRQLIDIVDQLKNNVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 137 - protein, 162 aa, synthetic construct
MRSSPGNMERIVICLMVIFLGTLVHKSSSQGQDRHMIRMRQLIDIVDQLKNYVNDEVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 138 - protein, 162 aa, synthetic construct
MRSSPGNMERIVICLMVIFLGTLVHKSSSQGQDRHMERMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 139 - protein, 162 aa, synthetic construct
MRSSPGNMERIVICLMVIFLGTLVHKSSSQGQDRHMIEMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 140 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCEQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 141 - protein, 162 aa, synthetic construct
MRSSPGNMERIVICLMVIFLGTLVHKSSSQGQDRHMIRMRQLIDIVDQLKNYVNDLVPEFLVAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 142 - protein, 162 aa, synthetic construct
MRSSPGNMERIVICLMVIFLGTLVHKSSSQGQDRHMIRMRQLIDIVDQLKNYVNDTVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 143 - protein, 162 aa, synthetic construct
MRSSPGNMERIVICLMVIFLGTLVHKSSSQGQDRHMKRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 144 - protein, 162 aa, synthetic construct
MRSSPGNMERIVICLMVIFLGTLVHKSSSQGQDRHMIRMRQLIDIVDQLKNYVNDLVPEFLPAPEDVETNCEWHAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 145 - protein, 162 aa, synthetic construct
MRSSPGNMERIVICLMVIFLGTLVHKSSSQGQDRHMIRMRQLIDIVDQLKNHVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 146 - protein, 162 aa, synthetic construct
MRSSPGNMERIVICLMVIFLGTLVHKSSSQGQDRHMIRMRQLITIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 147 - protein, 162 aa, synthetic construct
MRSSPGNMERIVICLMVIFLGTLVHKSSSQGQDRHMIRMRQLIDIVDQLKNQVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 148 - protein, 162 aa, synthetic construct
MRSSPGNMERIVICLMVIFLGTLVHKSSSQGQDRHMIRMRQLINIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 149 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVHIKKLKRKPPSTNAGRRQKHRLTCPSCDSYEKKPPKEFLERFKSLLQKMIHQHLSSRTHGSEDS

SEQ ID NO: 150 - protein, 162 aa, synthetic construct
MRSSPGNMERIVICLMVIFLGTLVHKSSSQGQDRHMIRMRQLIDIVDQLKNYHNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 151 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFRCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 152 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPKTNAGRRQKHRLTCPSCDSYEKKPPKEFLERFKSLLQKMIHQHLSSRTHGSEDS

SEQ ID NO: 153 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERTINVSIKKLKRKPPSTNAGRRQKHRLTCPSCDSYEKKPPKEFLERFKSLLQKMIHQHLSSRTHGSEDS

SEQ ID NO: 154 - protein, 162 aa, synthetic construct
MRSSPGNMERIVICLMVIFLGTLVHKSSSQGQDRHMIRMRQLIDIVDQLKNYVNDLVPEFLPAPEDVETNCELSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 155 - protein, 162 aa, synthetic construct
MRSSPGNMERIVICLMVIFLGTLVHKSSSQGQDRHMIRMRQLIDIVDQLKNYVNDLVPEFLPAPEDVETNCEWNAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 156 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLHKMIHQHLSSRTHGSEDS

SEQ ID NO: 157 - protein, 162 aa, synthetic construct
MRSSPGNMERIVICLMVIFLGTLVHKSSSQGQDRHMIRMRQLIDIVDQLKNYENDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 158 - protein, 162 aa, synthetic construct
MRSSPGNMERIVICLMVIFLGTLVHKSSSQGQDRHMIRMRQLIDIVDQLKNYTNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 159 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKMPPKEFLERFKSLLQKMIHQHLSSRTHGSEDS

SEQ ID NO: 160 - protein, 162 aa, synthetic construct
MRSSPGNMERIVICLMVIFLGTLVHKSSSQGQDRHMIRMRQLIDIVDQLKNYVNDLVPEFLPAPEDVETNCEASAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 161 - protein, 162 aa, synthetic construct
MRSSPGNMERIVICLMVIFLGTLVHKSSSQGQDSHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 162 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRHTCPSCDSYEKKPPKEFLERFKSLLQKMIHQHLSSRTHGSEDS

SEQ ID NO: 163 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSAKTGNNERIINVSIKKLKRKPPSTNAGRRQKHRLTCPSCDSYEKKPPKEFLERFKSLLQKMIHQHLSSRTHGSEDS

SEQ ID NO: 164 - protein, 162 aa, synthetic construct
MRSSPGNMERIVICLMVIFLGTLVHKSSSQGQDWHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 165 - protein, 162 aa, synthetic construct
MRSSPGNMERIVICLMVIFLGTLVHKSSSQGQARHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 166 - protein, 162 aa, synthetic construct
MRSSPGNMERIVICLMVIFLGTLVHKSSSQGQDRHMIRMRQLIDIVDQLKNYVNDLVPEFIPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 167 - protein, 162 aa, synthetic construct
MRSSPGNMERIVICLMVIFLGTLVHKSSSQGQDRHMQRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 168 - protein, 162 aa, synthetic construct
MRSSPGNMERIVICLMVIFLGTLVHKSSSQGQDDHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 169 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANLGNNERIINVSIKKLKRKPPSTNAGRRQKHRLTCPSCDSYEKKPPKEFLERFKSLLQKMIHQHLSSRTHGSEDS

SEQ ID NO: 170 - protein, 162 aa, synthetic construct
MRSSPGNMERIVICLMVIFLGTLVHKSSSQGQTRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 171 - protein, 162 aa, synthetic construct
MRSSPGNMERIVICLMVIFLGTLVHKSSSQGQDRHMIRMRQLIDIVDQLKNYVNDLVPEFLPAPEDVETNCEQSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 172 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFKCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 173 - protein, 162 aa, synthetic construct
MRSSPGNMERIVICLMVIFLGTLVHKSSSQGQDKHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 174 - protein, 162 aa, synthetic construct
MRSSPGNMERIVICLMVIFLGTLVHKSSSQGQNRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 175 - protein, 162 aa, synthetic construct
MRSSPGNMERIVICLMVIFLGTLVHKSSSQGQDRHMIRMRQLIDIVDQLKNYVNDLRPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 176 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHRHLSSRTHGSEDS

SEQ ID NO: 177 - protein, 162 aa, synthetic construct
MRSSPGNMERIVICLMVIFLGTLVHKSSSQGQSRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 178 - protein, 162 aa, synthetic construct
MRSSPGNMERIVICLMVIFLGTLVHKSSSQGQDRHMIRMRQLIDIVDQLKNYVNDLVPEFLPAPEDVETNCSWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 179 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKRRLTCPSCDSYEKKPPKEFLERFKSLLQKMIHQHLSSRTHGSEDS

SEQ ID NO: 180 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKHLLQKMIHQHLSSRTHGSEDS

SEQ ID NO: 181 - protein, 162 aa, synthetic construct
MRSSPGNMERIVICLMVIFLGTLVHKSSSQGQDHHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 182 - protein, 162 aa, synthetic construct
MRSSPGNMERIVICLMVIFLGTLVHKSSSQGQDGHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 183 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINHSIKKLKRKPPSTNAGRRQKHRLTCPSCDSYEKKPPKEFLERFKSLLQKMIHQHLSSRTHGSEDS

SEQ ID NO: 184 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRKTCPSCDSYEKKPPKEFLERFKSLLQKMIHQHLSSRTHGSEDS

SEQ ID NO: 185 - protein, 162 aa, synthetic construct
MRSSPGNMERIVICLMVIFLGTLVHKSSSQGQDRHMIRMRQLIDIVDQLKPYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 186 - protein, 162 aa, synthetic construct
MRSSPGNMERIVICLMVIFLGTLVHKSSSQGQDRHMIRMRQLIDAVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 187 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPLSTNAGRRQKHRLTCPSCDSYEKKPPKEFLERFKSLLQKMIHQHLSSRTHGSEDS

SEQ ID NO: 188 - protein, 162 aa, synthetic construct
MRSSPGNMERIVICLMVIFLGTLVHKSSSQGQDRHMIRMRQLIDIVDQLKNYVKDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 189 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNRGRRQKHRLTCPSCDSYEKKPPKEFLERFKSLLQKMIHQHLSSRTHGSEDS

SEQ ID NO: 190 - protein, 162 aa, synthetic construct
MRSSPGNMERIVICLMVIFLGTLVHKSSSQGQDRHMIRMRQLIDIVDQLKNYVNDLVPEILPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 191 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIIGVSIKKLKRKPPSTNAGRRQKHRLTCPSCDSYEKKPPKEFLERFKSLLQKMIHQHLSSRTHGSEDS

SEQ ID NO: 192 - protein, 162 aa, synthetic construct
MRSSPGNMERIVICLMVIFLGTLVHKSSSQGQQRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 193 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNGRIINVSIKKLKRKPPSTNAGRRQKHRLTCPSCDSYEKKPPKEFLERFKSLLQKMIHQHLSSRTHGSEDS

SEQ ID NO: 194 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKKRLTCPSCDSYEKKPPKEFLERFKSLLQKMIHQHLSSRTHGSEDS

SEQ ID NO: 195 - protein, 162 aa, synthetic construct
MRSSPGNMERIVICLMVIFLGTLVHKSSSQGQDRHMIRMRQLIDIVDQLKNYVNDMVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 196 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKYPSTNAGRRQKHRLTCPSCDSYEKKPPKEFLERFKSLLQKMIHQHLSSRTHGSEDS

SEQ ID NO: 197 - protein, 162 aa, synthetic construct
MRSSPGNMERIVICLMVIFLGTLVHKSSSQGQDRHMIRMRQLIDIVDQLKNYVNDLVPEFLPAPEDVRTNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 198 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPRTNAGRRQKHRLTCPSCDSYEKKPPKEFLERFKSLLQKMIHQHLSSRTHGSEDS

SEQ ID NO: 199 - protein, 162 aa, synthetic construct
MRSSPGNMERIVICLMVIFLGTLVHKSSSQGQDRHMIRMRQLIDIVDQLKNYVPDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 200 - protein, 162 aa, synthetic construct
MRSSPGNMERIVICLMVIFLGTLVHKSSSQGQDRHMIRMRQLIDIVDQLKNYVNDLVPEFLHAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 201 - protein, 162 aa, synthetic construct
MRSSPGNMERIVICLMVIFLGTLVHKSSSQGQDRHMIRMRQLIDIVDQLKNYVNDLVPSFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 202 - protein, 162 aa, synthetic construct
MRSSPGNMERIVICLMVIFLGTLVHKSSSQGQDRHMIRMRQLIDIVDQLKNYVNDLVPEFLPAPEDVETNCIWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 203 - protein, 162 aa, synthetic construct
MRSSPGNMERIVICLMVIFLGTLVHKSSSQGQDRHMIRMRQLIDIVDQLKNYVNDLVPEFLTAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 204 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHHSSRTHGSEDS

SEQ ID NO: 205 - protein, 162 aa, synthetic construct
MRSSPGNMERIVICLMVIFLGTLVHKSSSQGQDRHMIRMRQLIDIVDQLKNYVNDLVPEFLPAPEDVETNCEWAAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 206 - protein, 162 aa, synthetic construct
MRSSPGNMERIVICLMVIFLGTLVHKSSSQGQDRHMIRMRQLIDIVDQLKNYVNDLVPEFLPAPEDVETHCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 207 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAMSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 208 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKIANTGNNERIINVSIKKLKRKPPSTNAGRRQKHRLTCPSCDSYEKKPPKEFLERFKSLLQKMIHQHLSSRTHGSEDS

SEQ ID NO: 209 - protein, 162 aa, synthetic construct
MRSSPGNMERIVICLMVIFLGTLVHKSSSQGQDRHMIRMRQLIDIVDQLKNYVNDLVPERLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 210 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPISTNAGRRQKHRLTCPSCDSYEKKPPKEFLERFKSLLQKMIHQHLSSRTHGSEDS

SEQ ID NO: 211 - protein, 162 aa, synthetic construct
MRSSPGNMERIVICLMVIFLGTLVHKSSSQGQDRHMIRMRQLIDIVDQLKNYVHDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 212 - protein, 162 aa, synthetic construct
MRSSPGNMERIVICLMVIFLGTLVHKSSSQGQDEHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 213 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSNNTGNNERIINVSIKKLKRKPPSTNAGRRQKHRLTCPSCDSYEKKPPKEFLERFKSLLQKMIHQHLSSRTHGSEDS

SEQ ID NO: 214 - protein, 162 aa, synthetic construct
MRSSPGNMERIVICLMVIFLGTLVHKSSSQGQDRHMIRMRQLIDIVDQLKNYVNDLVPEFLPAPEDVETNCEYSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 215 - protein, 162 aa, synthetic construct
MRSSPGNMERIVICLMVIFLGTLVHKSSSQGQDRHMIRMRQLMDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 216 - protein, 162 aa, synthetic construct
MRSSPGNMERIVICLMVIFLGTLVHKSSSQGQDRHMIRMRQLIDIVDQLKNYVNDLVPEFLPAPEDVETNCHWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 217 - protein, 162 aa, synthetic construct
MRSSPGNMERIVICLMVIFLGTLVHKSSSQGQDYHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 218 - protein, 162 aa, synthetic construct
MRSSPGNMERIVICLMVIFLGTLVHKSSSQGQDRHMIRMRQLIDIVDQLKNYVNDLVPEFLPTPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 219 - protein, 162 aa, synthetic construct
MRSSPGNMERIVICLMVIFLGTLVHKSSSQGQDRHMIRMRQLIDIVDQLKNYVNDLVPEFLPAPEDVKTNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 220 - protein, 162 aa, synthetic construct
MRSSPGNMERIVICLMVIFLGTLVHKSSSQGQDRHMIRMRQLIDIVDGLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 221 - protein, 162 aa, synthetic construct
MRSSPGNMERIVICLMVIFLGTLVHKSSSQGQDRHMVRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 222 - protein, 162 aa, synthetic construct
MRSSPGNMERIVICLMVIFLGTLVHKSSSQGQDRHTIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 223 - protein, 162 aa, synthetic construct
MRSSPGNMERIVICLMVIFLGTLVHKSSSQGQDRHMIRMRSLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 224 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLESFKSLLQKMIHQHLSSRTHGSEDS

SEQ ID NO: 225 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIVNVSIKKLKRKPPSTNAGRRQKHRLTCPSCDSYEKKPPKEFLERFKSLLQKMIHQHLSSRTHGSEDS

SEQ ID NO: 226 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPIKEFLERFKSLLQKMIHQHLSSRTHGSEDS

SEQ ID NO: 227 - protein, 162 aa, synthetic construct
MRSSPGNMERIVICLMVIFLGTLVHKSSSQGQDRHMIRMRQLIDIVDQLKNYVNDLVPEFLPAPEDVETNCTWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 228 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPESTNAGRRQKHRLTCPSCDSYEKKPPKEFLERFKSLLQKMIHQHLSSRTHGSEDS

SEQ ID NO: 229 - protein, 162 aa, synthetic construct
MRSSPGNMERIVICLMVIFLGTLVHKSSSQGQDRHMIRMRQLIDIVDQLKNYVNDLVPEFLSAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 230 - protein, 162 aa, synthetic construct
MRSSPGNMERIVICLMVIFLGTLVHKSSSQGKDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 231 - protein, 162 aa, synthetic construct
MRSSPGNMERIVICLMVIFLGTLVHKSSSQGQDRHMIRMRQLIDIVDQLKNYVNDLVPEFLPAPERVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 232 - protein, 162 aa, synthetic construct
MRSSPGNMERIVICLMVIFLGTLVHKSSSQGQDRHMIRMRQLIDIVDQLKNYVNDLLPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 233 - protein, 162 aa, synthetic construct
MRSSPGNMERIVICLMVIFLGTLVHKSSSQGQDPHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 234 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKILLQKMIHQHLSSRTHGSEDS

SEQ ID NO: 235 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPMTNAGRRQKHRLTCPSCDSYEKKPPKEFLERFKSLLQKMIHQHLSSRTHGSEDS

SEQ ID NO: 236 - protein, 162 aa, synthetic construct
MRSSPGNMERIVICLMVIFLGTLVHKSSSQGQDRHMIRIRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 237 - protein, 162 aa, synthetic construct
MRSSPGNMERIVICLMVIFLGTLVHKSSSQGQDRHMIRMRQLIDIVDQLKVYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 238 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNTRIINVSIKKLKRKPPSTNAGRRQKHRLTCPSCDSYEKKPPKEFLERFKSLLQKMIHQHLSSRTHGSEDS

SEQ ID NO: 239 - protein, 162 aa, synthetic construct
MRSSPGNMERIVICLMVIFLGTLVHKSSSQGQDRHMIRMRQLIDIVDQLKNYVNDLVPEHLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 240 - protein, 162 aa, synthetic construct
MRSSPGNMERIVICLMVIFLGTLVHKSSSQGQDRHMIRMRQLIDIVDQLKGYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 241 - protein, 162 aa, synthetic construct
MRSSPGNMERIVICLMVIFLGTLVHKSSSQGQDRHMIRMRQLIDIVDQLKNYVNDLTPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 242 - protein, 162 aa, synthetic construct
MRSSPGNMERIVICLMVIFLGTLVHKSSSQGQDRHMIRMRQLIDIVDQLKNYVNDLMPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 243 - protein, 162 aa, synthetic construct
MRSSPGNMERIVICLMVIFLGTLVHKSSSQGQDRHMIRMRQLIDIVDQLKNYVNDLVPEFHPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 244 - protein, 162 aa, synthetic construct
MRSSPGNMERIVICLMVIFLGTLVHKSSSQGQDRHMIRMRQYIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 245 - protein, 162 aa, synthetic construct
MRSSPGNMERIVICLMVIFLGTLVHKSSSQGQDRHMIRMRQLIDIVDQLKNYVNDLVPEFLPAPEMVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 246 - protein, 162 aa, synthetic construct
MRSSPGNMERIVICLMVIFLGTLVHKSSSQGQDNHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 247 - protein, 162 aa, synthetic construct
MRSSPGNMERIVICLMVIFLGTLVHKSSSQGQDFHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 248 - protein, 162 aa, synthetic construct
MRSSPGNMERIVICLMVIFLGTLVHKSSSQGQDRHMIRMRQLIDIVDQLKNYVNDLYPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 249 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLGRKPPSTNAGRRQKHRLTCPSCDSYEKKPPKEFLERFKSLLQKMIHQHLSSRTHGSEDS

SEQ ID NO: 250 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQELSSRTHGSEDS

SEQ ID NO: 251 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRMTCPSCDSYEKKPPKEFLERFKSLLQKMIHQHLSSRTHGSEDS

SEQ ID NO: 252 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRSPPSTNAGRRQKHRLTCPSCDSYEKKPPKEFLERFKSLLQKMIHQHLSSRTHGSEDS

SEQ ID NO: 253 - protein, 162 aa, synthetic construct
MRSSPGNMERIVICLMVIFLGTLVHKSSSQGQDRHMIRMRQLIDIVDQLKNYVNDLVPEFLPAPEDVETNCLWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 254 - protein, 162 aa, synthetic construct
MRSSPGNMERIVICLMVIFLGTLVHKSSSQGQDRHMIRMRQLLDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 255 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPDSTNAGRRQKHRLTCPSCDSYEKKPPKEFLERFKSLLQKMIHQHLSSRTHGSEDS

SEQ ID NO: 256 - protein, 162 aa, synthetic construct
MRSSPGNMERIVICLMVIFLGTLVHKSSSQGQDRHMIRMRQLIDIVDQLKNYSNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 257 - protein, 162 aa, synthetic construct
MRSSPGNMERIVICLMVIFLGTLVHKSSSQGQDQHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 258 - protein, 162 aa, synthetic construct
MRSSPGNMERIVICLMVIFLGTLVHKSSSQGQDRHMIRMRQLIDIVDQLKNYANDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 259 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRNPPSTNAGRRQKHRLTCPSCDSYEKKPPKEFLERFKSLLQKMIHQHLSSRTHGSEDS

SEQ ID NO: 260 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRRQKHRLTCPSCDSYEKKPPKEFLERFKSLLQKMIHQHLSSRTHGSEDS

SEQ ID NO: 261 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHDHLSSRTHGSEDS

SEQ ID NO: 262 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHSHLSSRTHGSEDS

SEQ ID NO: 263 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRPPPSTNAGRRQKHRLTCPSCDSYEKKPPKEFLERFKSLLQKMIHQHLSSRTHGSEDS

SEQ ID NO: 264 - protein, 162 aa, synthetic construct
MRSSPGNMERIVICLMVIFLGTLVHKSSSQGQDAHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 265 - protein, 162 aa, synthetic construct
MRSSPGNMERIVICLMVIFLGTLVHKSSSQGQDRHMIRMRQLIDIVDQLKNYVNDLVPEFLPAPEDVETACEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 266 - protein, 162 aa, synthetic construct
MRSSPGNMERIVICLMVIFLGTLVHKSSSQGQDVHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 267 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRYTCPSCDSYEKKPPKEFLERFKSLLQKMIHQHLSSRTHGSEDS

SEQ ID NO: 268 - protein, 162 aa, synthetic construct
MRSSPGNMERIVICLMVIFLGTLVHKSSSQGQDRHMIFMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 269 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFMCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 270 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLSSANTGNNERIINVSIKKLKRKPPSTNAGRRQKHRLTCPSCDSYEKKPPKEFLERFKSLLQKMIHQHLSSRTHGSEDS

SEQ ID NO: 271 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNESIINVSIKKLKRKPPSTNAGRRQKHRLTCPSCDSYEKKPPKEFLERFKSLLQKMIHQHLSSRTHGSEDS

SEQ ID NO: 272 - protein, 162 aa, synthetic construct
MRSSPGNMERIVICLMVIFLGTLVHKSSSQGQDRPMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 273 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGFRQKHRLTCPSCDSYEKKPPKEFLERFKSLLQKMIHQHLSSRTHGSEDS

SEQ ID NO: 274 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKDLLQKMIHQHLSSRTHGSEDS

SEQ ID NO: 275 - protein, 162 aa, synthetic construct
MRSSPGNMERIVICLMVIFLGTLVHKSSSQGQDMHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 276 - protein, 162 aa, synthetic construct
MRSSPGNMERIVICLMVIFLGTLVHKSSSQGQDTHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 277 - protein, 162 aa, synthetic construct
MRSSPGNMERIVICLMVIFLGTLVHKSSSQGQDLHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 278 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNETIINVSIKKLKRKPPSTNAGRRQKHRLTCPSCDSYEKKPPKEFLERFKSLLQKMIHQHLSSRTHGSEDS

SEQ ID NO: 279 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRIQKHRLTCPSCDSYEKKPPKEFLERFKSLLQKMIHQHLSSRTHGSEDS

SEQ ID NO: 280 - protein, 162 aa, synthetic construct
MRSSPGNMERIVICLMVIFLGTLVHKSSSQGQDRHMIRMRQLIDIVDQLKEYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 281 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKVPPKEFLERFKSLLQKMIHQHLSSRTHGSEDS

SEQ ID NO: 282 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRTPPSTNAGRRQKHRLTCPSCDSYEKKPPKEFLERFKSLLQKMIHQHLSSRTHGSEDS

SEQ ID NO: 283 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKDPSTNAGRRQKHRLTCPSCDSYEKKPPKEFLERFKSLLQKMIHQHLSSRTHGSEDS

SEQ ID NO: 284 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKIRLTCPSCDSYEKKPPKEFLERFKSLLQKMIHQHLSSRTHGSEDS

SEQ ID NO: 285 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKREPPSTNAGRRQKHRLTCPSCDSYEKKPPKEFLERFKSLLQKMIHQHLSSRTHGSEDS

SEQ ID NO: 286 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRQQKHRLTCPSCDSYEKKPPKEFLERFKSLLQKMIHQHLSSRTHGSEDS

SEQ ID NO: 287 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRPQKHRLTCPSCDSYEKKPPKEFLERFKSLLQKMIHQHLSSRTHGSEDS

SEQ ID NO: 288 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGENERIINVSIEKLKRKPPSTEAGGGQKDTLECPSCDSYEKKPPKEFLERFKSLLQKMIHQHLSSRTHGSEDS

SEQ ID NO: 289 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGENERIINVSIEKLKRKPPSTNAGRRQKHRLTCPSCDSYEKKPPKEFLERFKSLLQKMIHQHLSSRTHGSEDS

SEQ ID NO: 290 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTEAGGGQKDTLECPSCDSYEKKPPKEFLERFKSLLQKMIHQHLSSRTHGSEDS

SEQ ID NO: 291 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTEAGRGQKDRLECPSCDSYEKKPPKEFLERFKSLLQKMIHQHLSSRTHGSEDS

SEQ ID NO: 292 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNAGGGQKDTLECPSCDSYEKKPPKEFLERFKSLLQKMIHQHLSSRTHGSEDS

SEQ ID NO: 293 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINDSIKKLKRKPPSTNAGRRQKHRLTCPSCDSYEKKPPKEFLERFKSLLQKMIHQHLSSRTHGSEDS

SEQ ID NO: 294 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 295 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIEKLKRKPPSTNAGRRQKHRLTCPSCDSYEKKPPKEFLERFKSLLQKMIHQHLSSRTHGSEDS

SEQ ID NO: 296 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGREQKHRLTCPSCDSYEKKPPKEFLERFKSLLQKMIHQHLSSRTHGSEDS

SEQ ID NO: 297 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQEAQLKSANTGNNERIINVSIKKLKRKPPSTNAGRRQKHRLTCPSCDSYEKKPPKEFLERFKSLLQKMIHQHLSSRTHGSEDS

SEQ ID NO: 298 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAELKSANTGNNERIINVSIKKLKRKPPSTNAGRRQKHRLTCPSCDSYEKKPPKEFLERFKSLLQKMIHQHLSSRTHGSEDS

SEQ ID NO: 299 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNEEIINVSIKKLKRKPPSTNAGRRQKHRLTCPSCDSYEKKPPKEFLERFKSLLQKMIHQHLSSRTHGSEDS

SEQ ID NO: 300 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIAKLKRKPPSTNAGRRQKHRLTCPSCDSYEKKPPKEFLERFKSLLQKMIHQHLSSRTHGSEDS

SEQ ID NO: 301 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIDKLKRKPPSTNAGRRQKHRLTCPSCDSYEKKPPKEFLERFKSLLQKMIHQHLSSRTHGSEDS

SEQ ID NO: 302 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNEDIINVSIKKLKRKPPSTNAGRRQKHRLTCPSCDSYEKKPPKEFLERFKSLLQKMIHQHLSSRTHGSEDS

SEQ ID NO: 303 - protein, 162 aa, synthetic construct
MRSSPGNMERIVICLMVIFLGTLVHKSSSQGQDRDMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 304 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKQLKRKPPSTNAGRRQKHRLTCPSCDSYEKKPPKEFLERFKSLLQKMIHQHLSSRTHGSEDS

SEQ ID NO: 305 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQNAQLKSANTGNNERIINVSIKKLKRKPPSTNAGRRQKHRLTCPSCDSYEKKPPKEFLERFKSLLQKMIHQHLSSRTHGSEDS

SEQ ID NO: 306 - protein, 162 aa, synthetic construct
MRSSPGNMERIVICLMVIFLGTLVHKSSSQGQDREMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 307 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRRQKHRLTCPSCDSYEKKPPKEFLERFKSLLQKMIHQHLSSRTHGSEDS

SEQ ID NO: 308 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHELTCPSCDSYEKKPPKEFLERFKSLLQKMIHQHLSSRTHGSEDS

SEQ ID NO: 309 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGDRQKHRLTCPSCDSYEKKPPKEFLERFKSLLQKMIHQHLSSRTHGSEDS

SEQ ID NO: 310 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQSAQLKSANTGNNERIINVSIKKLKRKPPSTNAGRRQKHRLTCPSCDSYEKKPPKEFLERFKSLLQKMIHQHLSSRTHGSEDS

SEQ ID NO: 311 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQEHRLTCPSCDSYEKKPPKEFLERFKSLLQKMIHQHLSSRTHGSEDS

SEQ ID NO: 312 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGPRQKHRLTCPSCDSYEKKPPKEFLERFKSLLQKMIHQHLSSRTHGSEDS

SEQ ID NO: 313 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRIPPSTNAGRRQKHRLTCPSCDSYEKKPPKEFLERFKSLLQKMIHQHLSSRTHGSEDS

SEQ ID NO: 314 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQRQKHRLTCPSCDSYEKKPPKEFLERFKSLLQKMIHQHLSSRTHGSEDS

SEQ ID NO: 315 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQMAQLKSANTGNNERIINVSIKKLKRKPPSTNAGRRQKHRLTCPSCDSYEKKPPKEFLERFKSLLQKMIHQHLSSRTHGSEDS

SEQ ID NO: 316 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGLRQKHRLTCPSCDSYEKKPPKEFLERFKSLLQKMIHQHLSSRTHGSEDS

SEQ ID NO: 317 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHDLTCPSCDSYEKKPPKEFLERFKSLLQKMIHQHLSSRTHGSEDS

SEQ ID NO: 318 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNEAIINVSIKKLKRKPPSTNAGRRQKHRLTCPSCDSYEKKPPKEFLERFKSLLQKMIHQHLSSRTHGSEDS

SEQ ID NO: 319 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQTAQLKSANTGNNERIINVSIKKLKRKPPSTNAGRRQKHRLTCPSCDSYEKKPPKEFLERFKSLLQKMIHQHLSSRTHGSEDS

SEQ ID NO: 320 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKDRLTCPSCDSYEKKPPKEFLERFKSLLQKMIHQHLSSRTHGSEDS

SEQ ID NO: 321 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQGAQLKSANTGNNERIINVSIKKLKRKPPSTNAGRRQKHRLTCPSCDSYEKKPPKEFLERFKSLLQKMIHQHLSSRTHGSEDS

SEQ ID NO: 322 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLLRKPPSTNAGRRQKHRLTCPSCDSYEKKPPKEFLERFKSLLQKMIHQHLSSRTHGSEDS

SEQ ID NO: 323 - protein, 162 aa, synthetic construct
MRSSPGNMERIVICLMVIFLGTLVHKSSSQGQDRYMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 324 - protein, 162 aa, synthetic construct
MRSSPGNMERIVICLMVIFLGTLVHKSSSQGQDRWMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 325 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRDQKHRLTCPSCDSYEKKPPKEFLERFKSLLQKMIHQHLSSRTHGSEDS

SEQ ID NO: 326 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKERLTCPSCDSYEKKPPKEFLERFKSLLQKMIHQHLSSRTHGSEDS

SEQ ID NO: 327 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQAAQLKSANTGNNERIINVSIKKLKRKPPSTNAGRRQKHRLTCPSCDSYEKKPPKEFLERFKSLLQKMIHQHLSSRTHGSEDS

SEQ ID NO: 328 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFECFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 329 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRYPPSTNAGRRQKHRLTCPSCDSYEKKPPKEFLERFKSLLQKMIHQHLSSRTHGSEDS

SEQ ID NO: 330 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQDHRLTCPSCDSYEKKPPKEFLERFKSLLQKMIHQHLSSRTHGSEDS

SEQ ID NO: 331 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSISKLKRKPPSTNAGRRQKHRLTCPSCDSYEKKPPKEFLERFKSLLQKMIHQHLSSRTHGSEDS

SEQ ID NO: 332 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKGLKRKPPSTNAGRRQKHRLTCPSCDSYEKKPPKEFLERFKSLLQKMIHQHLSSRTHGSEDS

SEQ ID NO: 333 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGIRQKHRLTCPSCDSYEKKPPKEFLERFKSLLQKMIHQHLSSRTHGSEDS

SEQ ID NO: 334 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKELKRKPPSTNAGRRQKHRLTCPSCDSYEKKPPKEFLERFKSLLQKMIHQHLSSRTHGSEDS

SEQ ID NO: 335 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRVPPSTNAGRRQKHRLTCPSCDSYEKKPPKEFLERFKSLLQKMIHQHLSSRTHGSEDS

SEQ ID NO: 336 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKALKRKPPSTNAGRRQKHRLTCPSCDSYEKKPPKEFLERFKSLLQKMIHQHLSSRTHGSEDS

SEQ ID NO: 337 - protein, 162 aa, synthetic construct; identical to SEQ ID NO: 287

SEQ ID NO: 338 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRRQKHRLTCPSCDSYEKKPPKEFLERFKSLLQKMIHQHLSSRTHGSEDS

SEQ ID NO: 339 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRNQKHRLTCPSCDSYEKKPPKEFLERFKSLLQKMIHQHLSSRTHGSEDS

SEQ ID NO: 340 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 341 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQQAQLKSANTGNNERIINVSIKKLKRKPPSTNAGRRQKHRLTCPSCDSYEKKPPKEFLERFKSLLQKMIHQHLSSRTHGSEDS

SEQ ID NO: 342 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHTLTCPSCDSYEKKPPKEFLERFKSLLQKMIHQHLSSRTHGSEDS

SEQ ID NO: 343 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGMRQKHRLTCPSCDSYEKKPPKEFLERFKSLLQKMIHQHLSSRTHGSEDS

SEQ ID NO: 344 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIIEVSIKKLKRKPPSTNAGRRQKHRLTCPSCDSYEKKPPKEFLERFKSLLQKMIHQHLSSRTHGSEDS

SEQ ID NO: 345 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNEQIINVSIKKLKRKPPSTNAGRRQKHRLTCPSCDSYEKKPPKEFLERFKSLLQKMIHQHLSSRTHGSEDS

SEQ ID NO: 346 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQNHRLTCPSCDSYEKKPPKEFLERFKSLLQKMIHQHLSSRTHGSEDS

SEQ ID NO: 347 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNENIINVSIKKLKRKPPSTNAGRRQKHRLTCPSCDSYEKKPPKEFLERFKSLLQKMIHQHLSSRTHGSEDS

SEQ ID NO: 348 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHGLTCPSCDSYEKKPPKEFLERFKSLLQKMIHQHLSSRTHGSEDS

SEQ ID NO: 349 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGARQKHRLTCPSCDSYEKKPPKEFLERFKSLLQKMIHQHLSSRTHGSEDS

SEQ ID NO: 350 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGNRQKHRLTCPSCDSYEKKPPKEFLERFKSLLQKMIHQHLSSRTHGSEDS

SEQ ID NO: 351 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRFPPSTNAGRRQKHRLTCPSCDSYEKKPPKEFLERFKSLLQKMIHQHLSSRTHGSEDS

SEQ ID NO: 352 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGRQKHRLTCPSCDSYEKKPPKEFLERFKSLLQKMIHQHLSSRTHGSEDS

SEQ ID NO: 353 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIQKLKRKPPSTNAGRRQKHRLTCPSCDSYEKKPPKEFLERFKSLLQKMIHQHLSSRTHGSEDS

SEQ ID NO: 354 - protein, 162 aa, synthetic construct; identical to SEQ ID NO: 286

SEQ ID NO: 355 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHPLTCPSCDSYEKKPPKEFLERFKSLLQKMIHQHLSSRTHGSEDS

SEQ ID NO: 356 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRLQKHRLTCPSCDSYEKKPPKEFLERFKSLLQKMIHQHLSSRTHGSEDS

SEQ ID NO: 357 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTEAGRRQKHRLTCPSCDSYEKKPPKEFLERFKSLLQKMIHQHLSSRTHGSEDS

SEQ ID NO: 358 - protein, 162 aa, synthetic construct
MRSSPGNMERIVICLMVIFLGTLVHKSSSQGQDRTMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 359 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLSRKPPSTNAGRRQKHRLTCPSCDSYEKKPPKEFLERFKSLLQKMIHQHLSSRTHGSEDS

SEQ ID NO: 360 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRFQKHRLTCPSCDSYEKKPPKEFLERFKSLLQKMIHQHLSSRTHGSEDS

SEQ ID NO: 361 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRWQKHRLTCPSCDSYEKKPPKEFLERFKSLLQKMIHQHLSSRTHGSEDS

SEQ ID NO: 362 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKTRLTCPSCDSYEKKPPKEFLERFKSLLQKMIHQHLSSRTHGSEDS

SEQ ID NO: 363 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFDCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 364 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNADRRQKHRLTCPSCDSYEKKPPKEFLERFKSLLQKMIHQHLSSRTHGSEDS

SEQ ID NO: 365 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQGHRLTCPSCDSYEKKPPKEFLERFKSLLQKMIHQHLSSRTHGSEDS

SEQ ID NO: 366 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKDLKRKPPSTNAGRRQKHRLTCPSCDSYEKKPPKEFLERFKSLLQKMIHQHLSSRTHGSEDS

SEQ ID NO: 367 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGERQKHRLTCPSCDSYEKKPPKEFLERFKSLLQKMIHQHLSSRTHGSEDS

SEQ ID NO: 368 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLMRKPPSTNAGRRQKHRLTCPSCDSYEKKPPKEFLERFKSLLQKMIHQHLSSRTHGSEDS

SEQ ID NO: 369 - protein, 162 aa, synthetic construct
MRSSPGNMERIVICLMVIFLGTLVHKSSSQGQDRHMIRMRQLIDIVDQLKNYVNDLVPEFLPAPEDVETDCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 370 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHLLTCPSCDSYEKKPPKEFLERFKSLLQKMIHQHLSSRTHGSEDS

SEQ ID NO: 371 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNDGRRQKHRLTCPSCDSYEKKPPKEFLERFKSLLQKMIHQHLSSRTHGSEDS

SEQ ID NO: 372 - protein, 162 aa, synthetic construct
MRSSPGNMERIVICLMVIFLGTLVHKSSSQGQDRHMIRMRQLIDIVDELKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 373 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRVQKHRLTCPSCDSYEKKPPKEFLERFKSLLQKMIHQHLSSRTHGSEDS

SEQ ID NO: 374 - protein, 162 aa, synthetic construct
MRSSPGNMERIVICLMVIFLGTLVHKSSSQGQDRHMIHMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 375 - protein, 162 aa, synthetic construct
MRSSPGNMERIVICLMVIFLGTLVHKSSSQGQDRHMIRMRELIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 376 - protein, 162 aa, synthetic construct
MRSSPGNMERIVICLMVIFLGTLVHKSSSQGQDRHMIRMRQLIDIVDQLKNYVNDLDPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 377 - protein, 162 aa, synthetic construct
MRSSPGNMERIVICLMVIFLGTLVHKSSSQGQDRHMIRMRQLIDIVDQLKNYVNDLVPEFFPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 378 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSINKLKRKPPSTNAGRRQKHRLTCPSCDSYEKKPPKEFLERFKSLLQKMIHQHLSSRTHGSEDS

SEQ ID NO: 379 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQQHRLTCPSCDSYEKKPPKEFLERFKSLLQKMIHQHLSSRTHGSEDS

SEQ ID NO: 380 - protein, 162 aa, synthetic construct
MRSSPGNMERIVICLMVIFLGTLVHKSSSQGQDRVMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 381 - protein, 162 aa, synthetic construct
MRSSPGNMERIVICLMVIFLGTLVHKSSSQGQDRAMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 382 - protein, 162 aa, synthetic construct
MRSSPGNMERIVICLMVIFLGTLVHKSSSQGQDRQMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 383 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRLPPSTNAGRRQKHRLTCPSCDSYEKKPPKEFLERFKSLLQKMIHQHLSSRTHGSEDS

SEQ ID NO: 384 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSILKLKRKPPSTNAGRRQKHRLTCPSCDSYEKKPPKEFLERFKSLLQKMIHQHLSSRTHGSEDS

SEQ ID NO: 385 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKNLKRKPPSTNAGRRQKHRLTCPSCDSYEKKPPKEFLERFKSLLQKMIHQHLSSRTHGSEDS

SEQ ID NO: 386 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGWRQKHRLTCPSCDSYEKKPPKEFLERFKSLLQKMIHQHLSSRTHGSEDS

SEQ ID NO: 387 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHQLTCPSCDSYEKKPPKEFLERFKSLLQKMIHQHLSSRTHGSEDS

SEQ ID NO: 388 - protein, 162 aa, synthetic construct
MRSSPGNMERIVICLMVIFLGTLVHKSSSQGQDRHMIRMLQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 389 - protein, 162 aa, synthetic construct
MRSSPGNMERIVICLMVIFLGTLVHKSSSQGQDRNMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 390 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGVRQKHRLTCPSCDSYEKKPPKEFLERFKSLLQKMIHQHLSSRTHGSEDS

SEQ ID NO: 391 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRDPPSTNAGRRQKHRLTCPSCDSYEKKPPKEFLERFKSLLQKMIHQHLSSRTHGSEDS

SEQ ID NO: 392 - protein, 162 aa, synthetic construct
MRSSPGNMERIVICLMVIFLGTLVHKSSSQGQDRHMIRMRQLIDIVDQLSNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 393 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAERRQKHRLTCPSCDSYEKKPPKEFLERFKSLLQKMIHQHLSSRTHGSEDS

SEQ ID NO: 394 - protein, 162 aa, synthetic construct; identical to SEQ ID NO: 285

SEQ ID NO: 395 - protein, 162 aa, synthetic construct
MRSSPGNMERIVICLMVIFLGTLVHKSSSQGQDRHMIRMRQLIDIVDQLKNYVNDLVPEFYPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 396 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGYRQKHRLTCPSCDSYEKKPPKEFLERFKSLLQKMIHQHLSSRTHGSEDS

SEQ ID NO: 397 - protein, 162 aa, synthetic construct
MRSSPGNMERIVICLMVIFLGTLVHKSSSQGQDRHMIRMRQLIDIVDQLLNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 398 - protein, 162 aa, synthetic construct
MRSSPGNMERIVICLMVIFLGTLVHKSSSQGQDRHMIRMRQLIDIVDQLKNYVNDLVPEELPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 399 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSITKLKRKPPSTNAGRRQKHRLTCPSCDSYEKKPPKEFLERFKSLLQKMIHQHLSSRTHGSEDS

SEQ ID NO: 400 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLDCPSCDSYEKKPPKEFLERFKSLLQKMIHQHLSSRTHGSEDS

SEQ ID NO: 401 - protein, 162 aa, synthetic construct
MRSSPGNMERIVICLMVIFLGTLVHKSSSQGQDRSMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 402 - protein, 162 aa, synthetic construct
MRSSPGNMERIVICLMVIFLGTLVHKSSSQGQDRHMIRMRQMIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 403 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRGQKHRLTCPSCDSYEKKPPKEFLERFKSLLQKMIHQHLSSRTHGSEDS

SEQ ID NO: 404 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVAIKKLKRKPPSTNAGRRQKHRLTCPSCDSYEKKPPKEFLERFKSLLQKMIHQHLSSRTHGSEDS

SEQ ID NO: 405 - protein, 162 aa, synthetic construct
MRSSPGNMERIVICLMVIFLGTLVHKSSSQGQDRHLIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 406 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGENERIINVSIKKLKRKPPSTNAGRRQKHRLTCPSCDSYEKKPPKEFLERFKSLLQKMIHQHLSSRTHGSEDS

SEQ ID NO: 407 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIDQHLSSRTHGSEDS

SEQ ID NO: 408 - protein, 162 aa, synthetic construct
MRSSPGNMERIVICLMVIFLGTLVHKSSSQGQDRHMIRMMQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 409 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGPNERIINVSIKKLKRKPPSTNAGRRQKHRLTCPSCDSYEKKPPKEFLERFKSLLQKMIHQHLSSRTHGSEDS

SEQ ID NO: 410 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRYQKHRLTCPSCDSYEKKPPKEFLERFKSLLQKMIHQHLSSRTHGSEDS

SEQ ID NO: 411 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHYLTCPSCDSYEKKPPKEFLERFKSLLQKMIHQHLSSRTHGSEDS

SEQ ID NO: 412 - protein, 162 aa, synthetic construct
MRSSPGNMERIVICLMVIFLGTLVHKSSSQGQDRHMIRMRQLIDIVDQLKNYVNDLVPEFLPAPEDVETECEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 413 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQYHRLTCPSCDSYEKKPPKEFLERFKSLLQKMIHQHLSSRTHGSEDS

SEQ ID NO: 414 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKMPSTNAGRRQKHRLTCPSCDSYEKKPPKEFLERFKSLLQKMIHQHLSSRTHGSEDS

SEQ ID NO: 415 - protein, 162 aa, synthetic construct
MRSSPGNMERIVICLMVIFLGTLVHKSSSQGQDRHMIRMQQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 416 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQDLSSRTHGSEDS

SEQ ID NO: 417 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKNRLTCPSCDSYEKKPPKEFLERFKSLLQKMIHQHLSSRTHGSEDS

SEQ ID NO: 418 - protein, 162 aa, synthetic construct
MRSSPGNMERIVICLMVIFLGTLVHKSSSQGQDRHMIRMRQLIDIVDQLKNYVNDLVPEFLPAPEDVEENCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 419 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLYRKPPSTNAGRRQKHRLTCPSCDSYEKKPPKEFLERFKSLLQKMIHQHLSSRTHGSEDS

SEQ ID NO: 420 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGTRQKHRLTCPSCDSYEKKPPKEFLERFKSLLQKMIHQHLSSRTHGSEDS

SEQ ID NO: 421 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQSHRLTCPSCDSYEKKPPKEFLERFKSLLQKMIHQHLSSRTHGSEDS

SEQ ID NO: 422 - protein, 162 aa, synthetic construct; identical to SEQ ID NO: 284

SEQ ID NO: 423 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVLIKKLKRKPPSTNAGRRQKHRLTCPSCDSYEKKPPKEFLERFKSLLQKMIHQHLSSRTHGSEDS

SEQ ID NO: 424 - protein, 162 aa, synthetic construct
MRSSPGNMERIVICLMVIFLGTLVHKSSSQGQDRHMIRMRQLIDIVDQLKNYVNDLVPEFLPAPEDVETNCEWEAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 425 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAPLKSANTGNNERIINVSIKKLKRKPPSTNAGRRQKHRLTCPSCDSYEKKPPKEFLERFKSLLQKMIHQHLSSRTHGSEDS

SEQ ID NO: 426 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQFHRLTCPSCDSYEKKPPKEFLERFKSLLQKMIHQHLSSRTHGSEDS

SEQ ID NO: 427 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKIPSTNAGRRQKHRLTCPSCDSYEKKPPKEFLERFKSLLQKMIHQHLSSRTHGSEDS

SEQ ID NO: 428 - protein, 162 aa, synthetic construct
MRSSPGNMERIVICLMVIFLGTLVHKSSSQGEDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 429 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVMIKKLKRKPPSTNAGRRQKHRLTCPSCDSYEKKPPKEFLERFKSLLQKMIHQHLSSRTHGSEDS

SEQ ID NO: 430 - protein, 162 aa, synthetic construct
MRSSPGNMERIVICLMVIFLGTLVHKSSSQGQDRHMIRMRQLIDIVDQLKNYVNDLVPEFLPAPEDVEDNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 431 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHSLTCPSCDSYEKKPPKEFLERFKSLLQKMIHQHLSSRTHGSEDS

SEQ ID NO: 432 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQAHRLTCPSCDSYEKKPPKEFLERFKSLLQKMIHQHLSSRTHGSEDS

SEQ ID NO: 433 - protein, 162 aa, synthetic construct
MRSSPGNMERIVICLMVIFLGTLVHKSSSQGQDRHMIRMRQLIDIVDQLKNYVNDLVPEPLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 434 - protein, 162 aa, synthetic construct
MRSSPGNMERIVICLMVIFLGTLVHKSSSQGQDRHMIRMYQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 435 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQLAQLKSANTGNNERIINVSIKKLKRKPPSTNAGRRQKHRLTCPSCDSYEKKPPKEFLERFKSLLQKMIHQHLSSRTHGSEDS

SEQ ID NO: 436 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRTQKHRLTCPSCDSYEKKPPKEFLERFKSLLQKMIHQHLSSRTHGSEDS

SEQ ID NO: 437 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKQRLTCPSCDSYEKKPPKEFLERFKSLLQKMIHQHLSSRTHGSEDS

SEQ ID NO: 438 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKADLKSANTGNNERIINVSIKKLKRKPPSTNAGRRQKHRLTCPSCDSYEKKPPKEFLERFKSLLQKMIHQHLSSRTHGSEDS

SEQ ID NO: 439 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 440 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKYANTGNNERIINVSIKKLKRKPPSTNAGRRQKHRLTCPSCDSYEKKPPKEFLERFKSLLQKMIHQHLSSRTHGSEDS

SEQ ID NO: 441 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKVRLTCPSCDSYEKKPPKEFLERFKSLLQKMIHQHLSSRTHGSEDS

SEQ ID NO: 442 - protein, 162 aa, synthetic construct
MRSSPGNMERIVICLMVIFLGTLVHKSSSQGQDRMMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 443 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLERKPPSTNAGRRQKHRLTCPSCDSYEKKPPKEFLERFKSLLQKMIHQHLSSRTHGSEDS

SEQ ID NO: 444 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLQRKPPSTNAGRRQKHRLTCPSCDSYEKKPPKEFLERFKSLLQKMIHQHLSSRTHGSEDS

SEQ ID NO: 445 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNEGIINVSIKKLKRKPPSTNAGRRQKHRLTCPSCDSYEKKPPKEFLERFKSLLQKMIHQHLSSRTHGSEDS

SEQ ID NO: 446 - protein, 162 aa, synthetic construct
MRSSPGNMERIVICLMVIFLGTLVHKSSSQGQDRHMIRMRQLIDIVDQLKNYVNDLVPEFLPAPEDVETNCEESAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 447 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNEYIINVSIKKLKRKPPSTNAGRRQKHRLTCPSCDSYEKKPPKEFLERFKSLLQKMIHQHLSSRTHGSEDS

SEQ ID NO: 448 - protein, 162 aa, synthetic construct
MRSSPGNMERIVICLMVIFLGTLVHKSSSQGQDRGMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 449 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRETCPSCDSYEKKPPKEFLERFKSLLQKMIHQHLSSRTHGSEDS

SEQ ID NO: 450 - protein, 162 aa, synthetic construct
MRSSPGNMERIVICLMVIFLGTLVHKSSSQGQDRLMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 451 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHFLTCPSCDSYEKKPPKEFLERFKSLLQKMIHQHLSSRTHGSEDS

SEQ ID NO: 452 - protein, 162 aa, synthetic construct; identical to SEQ ID NO: 283

SEQ ID NO: 453 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQPHRLTCPSCDSYEKKPPKEFLERFKSLLQKMIHQHLSSRTHGSEDS

SEQ ID NO: 454 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQIHRLTCPSCDSYEKKPPKEFLERFKSLLQKMIHQHLSSRTHGSEDS

SEQ ID NO: 455 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTDAGRRQKHRLTCPSCDSYEKKPPKEFLERFKSLLQKMIHQHLSSRTHGSEDS

SEQ ID NO: 456 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKFLKRKPPSTNAGRRQKHRLTCPSCDSYEKKPPKEFLERFKSLLQKMIHQHLSSRTHGSEDS

SEQ ID NO: 457 - protein, 162 aa, synthetic construct
MRSSPGNMERIVICLMVIFLGTLVHKSSSQGQDRHMIRMRQLIDIVDQLMNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 458 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQTHRLTCPSCDSYEKKPPKEFLERFKSLLQKMIHQHLSSRTHGSEDS

SEQ ID NO: 459 - protein, 162 aa, synthetic construct
MRSSPGNMERIVICLMVIFLGTLVHKSSSQGQDREMIRMRQLIDIVDQLKNYVNDLVPEFLPAPEDVETNCEWSAFSCFQKAQLKSANTGENERIINVSIKKLKRKPPSTNAGLRQKHRLTCPSCDSYEKKPPKEFLERFKSLLQKMIHQHLSSRTHGSEDS

SEQ ID NO: 460 - protein, 162 aa, synthetic construct
MRSSPGNMERIVICLMVIFLGTLVHKSSSQGQDRFMIRMRQDIDIVDQLKNYVNDLDPEFLPAPEDVETNCEWSAFSCFQKAQLKSANTGNNERIINVSIKKLKRKPPSTNAGQRQKHRLTCPSCDSYEKKPPKEFLERFKSLLQKMIHQHLSSRTHGSEDS

SEQ ID NO: 461 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNEEIINVSIKKLKRKPPSTNAGTRQKHRLTCPSCDSYEKKPPKEFLERFKSLLQKMIHQHLSSRTHGSEDS

SEQ ID NO: 462 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 463 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 464 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNEDIINVSIKKLKRKPPSTNAERRQKHMLECPSCDSYEKKPPKEFLERFKSLLQKMIHQHLSSRTHGSEDS

SEQ ID NO: 465 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 466 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINDSIKKLKRKPPSTNAGRGQKHRLTCPSCDSYEKKPPKEFLERFKSLLQKMIHQHLSSRTHGSEDS

SEQ ID NO: 467 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAELKSANTGNNERIINVSIKKLKRKPPSTNAGERQKHRLTCPSCDSYEKKPPKEFLERFKSLLQKMIHQHLSSRTHGSEDS

SEQ ID NO: 468 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQEAQLKSANTGNNERIINVSIKKLKRKPPSTLAGRGQKHRLTCPSCDSYEKKPPKEFLERFKSLLQKMIHQHLSSRTHGSEDS

SEQ ID NO: 469 - protein, 162 aa, synthetic construct
MRSSPGNMERIVICLMVIFLGTLVHKSSSQGQDRFMIRMLQLIDIVDQLKNYVNDLVPEFLPAPGDVETNCEWSAFSCFQKAQLKSANTGNNERIINVSIKKLKRRPPSTNAGREQKHRLTCPSCDSYEKKPPKEFLERFKSLLQKMIHQHLSSRTHGSEDS

SEQ ID NO: 470 - protein, 162 aa, synthetic construct
MRSSPGNMERIVICLMVIFLGTLVHKSSSQGQDRDMIRMRQLIDIVDQLKNYVNDLVPEFLPAPEDVETNCEWSAFSCFQKAGLKSANTGNNERIINQSIKKLKRKPPSTNAERRQKHRLTCPSCDSYEKKPPKEFLERFKSLLQKMIHQHLSSRTHGSEDS

SEQ ID NO: 471 - protein, 162 aa, synthetic construct
MRSSPGNMERIVICLMVIFLGTLVHKSSSQGVDRHMIRMRQLIDIVDQLKNYVNDLVPEFLPAPEDVETNCENSAFSCFQKAQLKSANTGNNERIINVAIKGLKRKPPSTNAGRDQKHRLTCPSCDSYEKKPPKEFLERFKSLLQKMIHQHLSSRTHGSEDS

SEQ ID NO: 472 - protein, 162 aa, synthetic construct
MRSSPGNMERIVICLMVIFLGTLVHKSSSQGQDRHMIRMRQLIDIVDQLKIYVNDLVPEFLPAPEDVEENCEWSAFSCFQKAQLKSANTGNNERIINVSIKKLKRKLPETNAGNRQKHRLTCPSCDSYEKKPPKEFLERFKSLLQKMIHQHLSSRTHGSEDS

SEQ ID NO: 473 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNEEIINVSIKKLKRKPPSTNAYRRQKDRTYCPSCDSYEKKPPKEFLERFKSLLQKMIHQHLSSRTHGSEDS

SEQ ID NO: 474 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNEPIINVSIKKLKRKVPLTNAGIRQKERLTCPSCDSYEKKPPKEFLERFKSLLQKMIHQHLSSRTHGSEDS

SEQ ID NO: 475 - protein, 162 aa, synthetic construct
MRSSPGNMERIVICLMVIFLGTLVHKSSSQGQDRYMIRMRQLIDIVDQLKNYVNDLVPEFLPAPEDVETNCESSAFSCFQKAQLKSANTGNNERIINVSIKKLKRKPPSVNAGRDQKHRLTCPSCDSYEKKPPKEFLERFKSLLQKMIHQHLSSRTHGSEDS

SEQ ID NO: 476 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTEAGRDQKHRLTCPSCDSYEKKPPKEFLERFKSLLQKMIHQHLSSRTHGSEDS

SEQ ID NO: 477 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQTAQLKSANTGNNERIINVSIKKLKRKPPSTNAGREQKHRLTCPSCDSYEKKPPKEFLERFKSLLQKMIHQHLSSRTHGSEDS

SEQ ID NO: 478 - protein, 162 aa, synthetic construct
MRSSPGNMERIVICLMVIFLGTLVHKSSSQGQDRTMIRMRQLIDIVDQLKNYVNDLKPEFLPAPEDVETNCEWSAFSCFQKAQLKSANTGNNERIINVSIKKLKRKPPSTNDGERQKHRLTCPSCDSYEKKPPKEFLERFKSLLQKMIHQHLSSRTHGSEDS

SEQ ID NO: 479 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNEEIINVSIKKLKRKLPSTNAGRRQKHRLTCPSCDSYEKKPPKEFLERFKSLLQKMIHQHLSSRTHGSEDS

SEQ ID NO: 480 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGVEQAHRLTCPSCDSYEKKPPKEFLERFKSLLQKMIHQHLSSRTHGSEDS

SEQ ID NO: 481 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGQNERIINVSIKQLKRKPPSDNAGRRQKHRLLCPSCDSYEKKPPKEFLERFKSLLQKMIHQHLSSRTHGSEDS

SEQ ID NO: 482 - protein, 162 aa, synthetic construct
MRSSPGNMERIVICLMVIFLGTLVHKSSSQGQDRHMIRMVQLIDIVDQLKNYVNDLVPEFLPAPEDVETDCEWSAFSCFQKAQLKSANTGNNERIINVSIKKLKRKPPSTNAGGRQKHRLTCPSCDSYEKKPPKEFLERFKSLLQKMIHQHLSSRTHGSEDS

SEQ ID NO: 483 - protein, 162 aa, synthetic construct
MRSSPGNMERIVICLMVIFLGTLVHKSSSQGQDSHMIRMRQLIDIVDQLKNYVNDLVPEFLPAPEDVETNCEWSAFSCFQKAQLKSANTGNNEEIINVSIKKLKRKPPATNAGRIQKHRLTCPSCDSYEKKPPKEFLERFKSLLQKMIHQHLSSRTHGSEDS

SEQ ID NO: 484 - protein, 162 aa, synthetic construct
MRSSPGNMERIVICLMVIFLGTLVHKSSSQGQDRHMIRMRQLIDIVDSLENYVNDLVPEFLPAPEDVITNCEWSAFSCFQKAQLKSANTGNNERIINVSIKQLKRKPPSTNAGDRQKHRLTCPSCDSYEKKPPKEFLERFKSLLQKMIHQHLSSRTHGSEDS

SEQ ID NO: 485 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNENIINVSIKKLKRKPPSTNAGRRQKERLTCPSCDSYEKKPPKEFLERFKSLLQKMIHQHLSSRTHGSEDS

SEQ ID NO: 486 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQTAQLKSANTGNNERIINVSIKQLKRKPPSTNAGRRQKHRLTCPSCDSYEKKPPKEFLERFKSLLQKMIHQHLSSRTHGSEDS

SEQ ID NO: 487 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNETIINVSIKKLKRKPPSTNAGTEQKHRLTCPSCESYEKKPPKVFLERFKSLLQKMIHQHLSSRTHGSEDS

SEQ ID NO: 488 - protein, 162 aa, synthetic construct
MRSSPGNMERIVICLMVIFLGTLVHKSSSQGGDRHMIRMRQLIDIVDQLKNYVNDLVPEFLPAPEDVETNCEWSAFSCFQKAQLKSANTGNNERIINVSIKKLKRKPPSTEAGRPQKHRLTCPSCDSYEKKPPKEFLERFKSLLQKMIHQHLSSRTHGSEDS

SEQ ID NO: 489 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGIGQKHRLTCPSCDSYEKKPPKEFLERFKSLLQKMIHQHLSSRTHGSEDS

SEQ ID NO: 490 - protein, 162 aa, synthetic construct
MRSSPGNMERIVICLMVIFLGTLVHKSSSQGQDRHMIRMRQLIDIVDQLKNYVNDLVPEFLPAPEDVETECEWSAFSCFQKAQLKSANTGNNERIINVSIKKLKRKPPSTNAGGRQKHRLTCPSCDSYEKKPPKEFLERFKSLLQKMIHQHLSSRTHGSEDS

SEQ ID NO: 491 - protein, 162 aa, synthetic construct
MRSSPGNMERIVICLMVIFLGTLVHKSSSQGQDRFMIRMYQLIDVVDQLKNYVNDLVPEFLPAPEDVEDNCEWSAFSCFQKAQLKSANAGNNERIINVSIKKLKRKPPSTNAGRRQKHRLTCPSCDSYEKKPPKEFLERFKSLLQKMIHQHLSSRTHGSEDS

SEQ ID NO: 492 - protein, 162 aa, synthetic construct
MRSSPGNMERIVICLMVIFLGTLVHKSSSQGQDREMIRMRQLIDIVDQLKIYVNDLVPEFLPAPEDVEDNCEWSAFSCFQKAQLKSANTGNNERIINVSIKKLKRKPPSTNAGRKQKHRLTCPSCDSYEKKPPKEFLERFKSLLQKMIHQHLSSRTHGSEDS

SEQ ID NO: 493 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSISKLKRKPPSTNAGARQKHHLTCPSCDSYEKKPPKEFLERFKSLLQKMIHQHLSSRTHGSEDS

SEQ ID NO: 494 - protein, 162 aa, synthetic construct
MRSSPGNMERIVICLMVIFLGTLVHKSSSQGQDRHLIRMRQLIDIVDQLKNYVNDLVPEFLPAPEDVETNCEWSAFSCFQKAQLKSANTGNNERIINVSIKKLKRKPPSTNAGRDQKHRLTCPSCDSYEKKPPKEFLERFKSLLQKMIHQHLSSRTHGSEDS

SEQ ID NO: 495 - protein, 162 aa, synthetic construct
MRSSPGNMERIVICLMVIFLGTLVHKSSSQGQDRAMIRMRQLIDIVDQLKNYVNDLVPEFLPAPEDVETNCYWSAFSCFQKAQLKSANTGNNERIINVSIKKLKRKPPSTNGEYRQKHRLTCPSCDSYEKKPPKEFLERFKSLLQKMIHQHLSSRTHGSEDS

SEQ ID NO: 496 - protein, 162 aa, synthetic construct
MRSSPGNMERIVICLMVIFLGTLVHKSSSQGQDREMIRMRQLIDIVDQLKNYVNDLVPEFLPAPEDVETNCEWSAFSCFQKAQLKSANTGNNERIINVSIKKLKRKPPSTNADRRQKHRLTCPSCDSYEKKPPKEFLERFKSLLQKMIHQHLSSRTHGSEDS

SEQ ID NO: 497 - protein, 162 aa, synthetic construct
MRSSPGNMERIVICLMVIFLGTLVHKSSSQGQDREMIRMRQLIDIVDQLKNYVNDLVPEFLPAPEDVEENCEWSAFSCFQKAQLQSANTGNNERIINVSIKKLKRKPPSTNAARRQKHRLTCPSCDSYEKKPPKEFLERFKSLLQKMIHQHLSSRTHGSEDS

SEQ ID NO: 498 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNESIINVSIKKLKRKPPSTNAGARQKHRLTCPSCDSYEKKPPKEFLERFKSLLQKMIHQHLSSRTHGSEDS

SEQ ID NO: 499 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIVNVTIKKLKRKPPSDNAGERQKHRLTCPSCDSYEKKPPKEFLERFKSLLQKMIHQHLSSRTHGSEDS

SEQ ID NO: 500 - protein, 162 aa, synthetic construct
MRSSPGNMERIVICLMVIFLGTLVHKSSSQGEDRHMIYMRQLIDIVDQLKNYVNDLVPEFLPAPEDVETNCEWSAFSCFQKAQLKSANTGNNERIINVSIKQLKRKPPSTVAGRRQKHRLTCPSCDSYEKKPPKEFLERFKSLLQKMIHQHLSSRTHGSEDS

SEQ ID NO: 501 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGTEQKHRLTCPSCDSYEKKPPKEFLERFKSLLQKMIHQHLSSRTHGSEDS

SEQ ID NO: 502 - protein, 162 aa, synthetic construct
MRSSPGNMERIVICLMVIFLGTLVHKSSSQGQDRHMIRMRQLIDIVDQLKNYVNDLVPEFLPAPEDVETACEWSAFSCFQKAQLKSANTGNNENIINVSIKKLKRKLPSTNAGRRQKHTLTCPSCDSYEKKPPKEFLERFKSLLQKMIHQHLSSRTHGSEDS

SEQ ID NO: 503 - protein, 162 aa, synthetic construct
MRSSPGNMERIVICLMVIFLGTLVHKSSSQGQDREQIRMRQLIDIVDQLKNYVNDLVPEFLPAPEDVETDCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 504 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGIGQKGRLTCPSCDSYEKKPPKEFLERFKSLLQKMIHQHLSSRTHGSEDS

SEQ ID NO: 505 - protein, 162 aa, synthetic construct
MRSSPGNMERIVICLMVIFLGTLVHKSSSQGQDRTAIRMRQLIDIVDQLKNYVNDLVPEFLPAPEDVETNCEWSAFSCFQKAQLKSANTGNNERIINVSIKKLKRKPPSTNAGRPQKHRLTCPSCDSYEKKPPKEFLERFKSLLQKMIHQHLSSRTHGSEDS

SEQ ID NO: 506 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNETIINVSIKKLKRKPPSTNAGRRQKHELTCPSCDSYEKKPPKEFLERFKSLLQKMIHQHLSSRTHGSEDS

SEQ ID NO: 507 - protein, 162 aa, synthetic construct
MRSSPGNMERIVICLMVIFLGTLVHKSSSQGQDRHMIRMRQLIDIVDQLKHYVNDLEPEFLPAPEDVETECEWSAFSCFQKAQLKSANTGNNERIINVSIEKLKRKPPSTNAGRRQKHRLTCPSCDSYEKKPPKEFLERFKSLLQKMIHQHLSSRTHGSEDS

SEQ ID NO: 508 - protein, 162 aa, synthetic construct
MRSSPGNMERIVICLMVIFLGTLVHKSSSQGSDTHMIRMRQLIDIVDQLKNYVNDLVPEFLPAPEDVETNCEWSALSCFQKAQLKSANTGNNERIINDSIKKLKRKPPSTNAGRRQKHRLTCPSCDSYEKKPPKEFLERFKSLLQKMIHQHLSSRTHGSEDS

SEQ ID NO: 509 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGENERIINVSISKLKRKPPSTSAGRRQKHRLTCPSCDSYEKKPPKEFLERFKSLLQKMIHQHLSSRTHGSEDS

SEQ ID NO: 510 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVTIKKLKRKPPSTNAGRRQKSDLTCPSCDSYEKKPPKEFLERFKSLLQKMIHQHLSSRTHGSEDS

SEQ ID NO: 511 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNMDTRQKHRLTCPSCDSYEKKPPKEFLERFKSLLQKMIHQHLSSRTHGSEDS

SEQ ID NO: 512 - protein, 162 aa, synthetic construct
MRSSPGNMERIVICLMVIFLGTLVHKSSSQGMDRHMIRMRQLIDIVDQLKNYVNDLVPEFLPAPEDVETNCEWSAFSCFQKAQLKSANTGNNERIINVSIKKLKRKPPSTNAGRDQKHRLTCPSCDSYEKKPPKEFLERFKSLLQKMIHQHLSSRTHGSEDS

SEQ ID NO: 513 - protein, 162 aa, synthetic construct
MRSSPGNMERIVICLMVIFLGTLVHKSSSQGQDRDMIRMRQLIDIVDQLKNYVNDLVPEFLPAPEDVETNCEWSAFSCFQKAQLKSANTGNNERIINVSIKKLKRKIPITNAGRRQKHRLTCPSCDSYEKKPPKEFLERFKSLLQKMIHQHLSSRTHGSEDS

SEQ ID NO: 514 - protein, 162 aa, synthetic construct
MRSSPGNMERIVICLMVIFLGTLVHKSSSQGQDRTMIRLRQLIDIVDQLKNYVNDLVPEFLPAPEDVETNCEWSAFSCFQKAQLKSANTGNNERIINTSIKKLKRKPPSTNAGRRQKHRLTCPSCDSYEKKPPKEFLERFKSLLQKMIHQHLSSRTHGSEDS

SEQ ID NO: 515 - protein, 162 aa, synthetic construct
MRSSPGNMERIVICLMVIFLGTLVHKSSSQGQDRHMIRMRQLIDIVDDLKNYVNDLVPEFLPAPEDVETNCEWSAFSCFQKAQLKSANTGNNERIINVSIKKLKRKPPSTNAGARQKHRLTCPSCDSYEKKPPKEFLERFKSLLQKMIHQHLSSRTHGSEDS

SEQ ID NO: 516 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGREQKHRETCPSCDSYEKKPPKEFLERFKSLLQKMIHQHLSSRTHGSEDS

SEQ ID NO: 517 - protein, 162 aa, synthetic construct
MRSSPGNMERIVICLMVIFLGTLVHKSSSQGQDRHMIRMRQLIDIVDQLKNYVNDLVPEFLPAPEDVETNCEFSAFSCFQKAQLKSANTGNNERIINVSIKKLKRKVPSTNAGKRQKDNLTCPSCDSYEKKPPKEFLERFKSLLQKMIHQHLSSRTHGSEDS

SEQ ID NO: 518 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGVGQKHRLTCPSCDSYEKKPPKEFLERFKSLLQKMIHQHLSSRTHGSEDS

SEQ ID NO: 519 - protein, 162 aa, synthetic construct
MRSSPGNMERIVICLMVIFLGTLVHKSSSQGQDRHMIRMRQLIDIVDQLKNYVNDLVPEFLPAPEDVKTNCEWSAFSCFQKAQLKSANTGNNERIINDSIKKLKRKPPSTNAGRRQKHRLTCPSCDSYEKKPPKEFLERFKSLLQKMIHQHLSSRTHGSEDS

SEQ ID NO: 520 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTDAGGRQKHRLTCPSCDSYEKKPPKEFLERFKSLLQKMIHQHLSSRTHGSEDS

SEQ ID NO: 521 - protein, 162 aa, synthetic construct
MRSSPGNMERIVICLMVIFLGTLVHKSSSQGQDRHMIRMRQLIDIVDQLKNYVNDLVPELLPAPEDVETNCEWSAFSCFQKAQLKSANTGNNERIINVSIKKLKRKPPSTNAGRDQKHRLTCPSCDSYEKKPPKEFLERFKSLLQKMIHQHLSSRTHGSEDS

SEQ ID NO: 522 - protein, 162 aa, synthetic construct
MRSSPGNMERIVICLMVIFLGTLVHKSSSQGQDRSMIRMRQLIDIVDQLKNYVNDLVPEFLPAPEDVETNCEWSAFACFQKAQLKSANTGNNERIINMSIKKLKRKPPSTNAGRRQKHRLTCPSCDSYEKKPPKEFLERFKSLLQKMIHQHLSSRTHGSEDS

SEQ ID NO: 523 - protein, 162 aa, synthetic construct
MRSSPGNMERIVICLMVIFLGTLVHKSSSQGQDRHMIRMRQLIDIVDQLKNYVNDLVPEFLPAPEDVETNCLWSAFSCFQKAQLKSANTGNNERIINVSIKKLKRKPPSTNAGARQKHNLTCPSCDSYEKKPPKEFLERFKSLLQKMIHQHLSSRTHGSEDS

SEQ ID NO: 524 - protein, 162 aa, synthetic construct
MRSSPGNMERIVICLMVIFLGTLVHKSSSQGQDRHMIRMRQLIDIVDQLKNYVNDLVPEFLPAPEDVEENCEWSAFSCFQKAQLKSANTGNNERIINVSILKLKRKPPSTEASRRQKHRLTCPSCDSYEKKPPKEFLERFKSLLQKMIHQHLSSRTHGSEDS

SEQ ID NO: 525 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAELKSANTGNNERIINVSIKKLKRKPPPTNAGRRQKHRLTCPSCDSYEKKPPKEFLERFKSLLQKMIHQHLSSRTHGSEDS

SEQ ID NO: 526 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNEQIINVSIKKLKRKPPSTMERRYQKHRLTCPSCDSYEKKPPKEFLERFKSLLQKMIHQHLSSRTHGSEDS

SEQ ID NO: 527 - protein, 162 aa, synthetic construct
MRSSPGNMERIVICLMVIFLGTLVHKSSSQGQDRHMIRMRQLIDIVDQLKNYVNDLVPEFLPAPEDVETHCEWSAFSCFQKAQLKSANTGNNEAIINVSIKKLKRKPPSTNDGRRQKHRLTCPSCDSYEKKPPKEFLERFKSLLQKMIHQHLSSRTHGSEDS

SEQ ID NO: 528 - protein, 162 aa, synthetic construct
MRSSPGNMERIVICLMVIFLGTLVHKSSSQGQDREGIRMRQLIDIVDQLKNYVNDLVPEFLPAPEDVETNCEWSAFSCFQKAQLKSANTGNNERIINVSIKKLKRTPPSTNAGRRQKHRLTCPSCDSYEKKPPKEFLERFKSLLQKMIHQHLSSRTHGSEDS

SEQ ID NO: 529 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQNAQLKSANTGNNERIINVSIKKLKRKPPSTPAGRRQKHRLTCPSCDSYEKKPPKEFLERFKSLLQKMIHQHLSSRTHGSEDS

SEQ ID NO: 530 - protein, 162 aa, synthetic construct
MRSSPGNMERIVICLMVIFLGTLVHKSSSQGIDRHMIRMLQLIDIVDQLKNYVNDLVPEFLPAPEDVETNCEWSAFSCFQSAQLKSANTGNNERIINVSIKKLKRKPPSTNAGRRQKHRLTCPSCDSYEKKPPKEFLERFKSLLQKMIHQHLSSRTHGSEDS

SEQ ID NO: 531 - protein, 162 aa, synthetic construct
MRSSPGNMERIVICLMVIFLGTLVHKSSSQGQDRSMIRMRQLIDIVDQLKNYVNDLVPEFLPAPEDVETNCEWSAFSCFQKAQLKSANTGNNERIIDVSIKKLKRKPPSTIAGRRQKHRLTCPSCDSYEKKPPKEFLERFKSLLQKMIHQHLSSRTHGSEDS

SEQ ID NO: 532 - protein, 162 aa, synthetic construct
MRSSPGNMERIVICLMVIFLGTLVHKSSSQGQDRNMFRMQQLIDIVDQLKNYVNDLVPEFLPAPSDVETNCEWSAFSCFQKAQLKSANTGNNERIINVSIKKLKRKPPSTNAGRSQKHRLTCPSCDSYEKKPPKEFLERFKSLLQKMIHQHLSSRTHGSEDS

SEQ ID NO: 533 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAELKSANTGNNERIINVSIKKLKRKPPSTNAGRRQKHRLTCPSCDSYEKKPPKEFLERFKSLLQKMIHQHLSSRTHGSEDS

SEQ ID NO: 534 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANSGNNERIINVAIKKLKRKPPSTNAGGRQKHRLTCPSCDSYEKKPPKEFLERFKSLLQKMIHQHLSSRTHGSEDS

SEQ ID NO: 535 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGGRQKHRLTCPSCDSYEKKPPKEFLERFKSLLQKMIHQHLSSRTHGSEDS

SEQ ID NO: 536 - protein, 162 aa, synthetic construct
MRSSPGNMERIVICLMVIFLGTLVHKSSSQGQDRHMIRMRQLIDIVDQLGNYVNDLVPEFLPAPEDVETNCEWSAFSCFQKAQLKSANTGNNEEIINVSIKKLKRKPPSTNAGRRQKHRLTCPSCDSYEKKPPKEFLERFKSLLQKMIHQHLSSRTHGSEDS

SEQ ID NO: 537 - protein, 162 aa, synthetic construct
MRSSPGNMERIVICLMVIFLGTLVHKSSSQGQDRHMIRMRQLIDGVDQLKNYVNDLVQEFLPAPEDVETNCEWSAFSCFQKAQLKSANTGNNERIINESIKKLKRKPPSTNAGRRQKHRLTCPSCDSYEKKPPKEFLERFKSLLQKMIHQHLSSRTHGSEDS

SEQ ID NO: 538 - protein, 162 aa, synthetic construct
MRSSPGNMERIVICLMVIFLGTLVHKSSSQGQDRHMIRLRQLIDIVDQLKNYVNDLVPEFLPAPEDVETNCEWSAFSCFQKAQLKSANTGNNERIINVSIKKLKRKPPSTNAGRGQKHRLTCPSCDSYEKKPPKEFLERFKSLLQKMIHQHLSSRTHGSEDS

SEQ ID NO: 539 - protein, 162 aa, synthetic construct
MRSSPGNMERIVICLMVIFLGTLVHKSSSQGQDRHMIRMRQLIDIVDQLKNYVNDLVPEFLPAPEDVETHCEDSAFSCFQKAQLKVANAGNNERIINVSIKKLKRFPPSTNAGRRQKHRLTCPSCDSYEKKPPKEFLERFKSLLQKMIHQHLSSRTHGSEDS

SEQ ID NO: 540 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNEGRRQKGTLNCPSCDSYEKKPPKEFLERFKSLLQKMIHQHLSSRTHGSEDS

SEQ ID NO: 541 - protein, 162 aa, synthetic construct
MRSSPGNMERIVICLMVIFLGTLVHKSSSQGQDRFLIRMRQLIDIVDQLKNYENDLVPEFLPAPEDVETNCEWSAFSCFQKAQLKSANTGNNERIINVSIKKLKRPPPSTNAGRAQKHRLTCPSCDSYEKKPPKEFLERFKSLLQKMIHQHLSSRTHGSEDS

SEQ ID NO: 542 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGRQKGRLECPSCDSYEKKPPKEFLERFKSLLQKMIHQHLSSRTHGSEDS

SEQ ID NO: 543 - protein, 162 aa, synthetic construct
MRSSPGNMERIVICLMVIFLGTLVHKSSSQGQDRHMIRMRQLIDIVDQLSNYVNDLVPEFLPAPEDVETNCEWSAFSCFQKAQLKSANTGNNERIINVSIKKLKRKTPSTNAGVRQKHRLTCPSCDSYEKKPPKEFLERFKSLLQKMIHQHLSSRTHGSEDS

SEQ ID NO: 544 - protein, 162 aa, synthetic construct
MRSSPGNMERIVICLMVIFLGTLVHKSSSQGQDRHMIRMMQLIDIVDQLKNYVNDLVPEFLPAPEDVETNCEWSAFSCFQKAQLKSANTGNNERIINVSIKKLKRKPPSTNAGARQKHRLTCPSCDSYEKKPPKEFLERFKSLLQKMIHQHLSSRTHGSEDS

SEQ ID NO: 545 - protein, 162 aa, synthetic construct
MRSSPGNMERIVICLMVIFLGTLVHKSSSQGQDRHMIRMRQLIDIVDQLKNYVNDLNPEFLPAPEDVETNCEWSAFSCFQKAQLKSANTGNNEQIINVAIKKLKRKPPSTNYGRRQKHRLTCPSCDSYEKKPPKEFLERFKSLLQKMIHQHLSSRTHGSEDS

SEQ ID NO: 546 - protein, 162 aa, synthetic construct
MRSSPGNMERIVICLMVIFLGTLVHKSSSQGQDRHMIRMRQLIDIVDQLKNYVNELVPEFLPAPEDVETNCEWSAFSCFQKAQLKSAKTGNNERIINVSIKKLKRKPPSTNAMAEQKHRLTCPSCDSYEKKPPKEFLERFKSLLQKMIHQHLSSRTHGSEDS

SEQ ID NO: 547 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRDQKHRLECPSCDSYEKKPPKEFLERFKSLLQKMIHQHLSSRTHGSEDS

SEQ ID NO: 548 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSSNAGRDMKIRLTCPSCDSYEKKPPKEFLERFKSLLQKMIYQHLSSRTHGSEDS

SEQ ID NO: 549 - protein, 162 aa, synthetic construct
MRSSPGNMERIVICLMVIFLGTLVHKSSSQGQDRHMIRMRQLIDIVDQLKNYVNDLVPEFLPAPEDVETECEWSAFSCFQKAQLKSANTGNNERIINVSIKKLKRKPPSTDAGRRQKHRLTCPSCDSYEKKPPKEFLERFKSLLQKMIHQHLSSRTHGSEDS

SEQ ID NO: 550 - protein, 162 aa, synthetic construct
MRSSPGNMERIVICLMVIFLGTLVHKSSSQGQDRHMIRMRQLIDEVDQLKNYVNDLVPESLPAPEDVETNCEWSAFSCFQKAQLKSANTGNNERIIDVSIKKLKRVPPSTNAGRRQKHRLTCPSCDSYEKKPPKEFLERFKSLLQKMIHQHLSSRTHGSEDS

SEQ ID NO: 551 - protein, 162 aa, synthetic construct
MRSSPGNMERIVICLMVIFLGTLVHKSSSQGQDRFMIRMRQLIDIVDQLKNYVNDLVPESLPAPEDVETNCEWSAFSCFQKAQLKSANTGNNERIINVSIKKLKRKPPSTNAKIRQKHRLTCPSCDSYEKKPPKEFLERFKSLLQKMIHQHLSSRTHGSEDS

SEQ ID NO: 552 - protein, 162 aa, synthetic construct
MRSSPGNMERIVICLMVIFLGTLVHKSSSQGQDRHMIRMRQLIDIVDQLKNYVNDLVVEFLPAPEDVETNCEWSAFSCFQKAQLKSANTGNNERIINVSIEKLKRKPPSTNAGARQKHRLTCPSCDSYEKKPPKEFLERFKSLLQKMIHQHLSSRTHGSEDS

SEQ ID NO: 553 - protein, 162 aa, synthetic construct
MRSSPGNMERIVICLMVIFLGTLVHKSSSQGQDRHMIRMRQLIDIVDQLKHYVNDLVPEFLPAPEDVEENCEWSAFSCFQSAQLKSANTGNNERIINVSIKKLKRKPPSTNAGRRQKHRLTCPSCDSYEKKPPKEFLERFKSLLQKMIHQHLSSRTHGSEDS

SEQ ID NO: 554 - protein, 162 aa, synthetic construct
MRSSPGNMERIVICLMVIFLGTLVHKSSSQGQDRFPIRMRQLIDIVDQLKNYVNDLVPEFLPAPEDVETNCEWSAFSCFQKAQLKSAETGNNERIINQSIKKLKRKPPSTNAGRRQKHRLTCPSCDSYEKKPPKEFLERFKSLLQKMIHQHLSSRTHGSEDS

SEQ ID NO: 555 - protein, 162 aa, synthetic construct
MRSSPGNMERIVICLMVIFLGTLVHKSSSQGQDRHMIRMRQLIDIVGQLKNYVNDLVPEFLPAPEDVETNCEWSAFSCFQKAQLKSANTGNNERIINVAIKKLKRLPPSTQAGVRQKHRLTCPSCDSYEKKPPKEFLERFKSLLQKMIHQHLSSRTHGSEDS

SEQ ID NO: 556 - protein, 162 aa, synthetic construct
MRSSPGNMERIVICLMVIFLGTLVHKSSSQGFDRHMIRMRQLIDIVDQLKNYVNDLVPEFLPTPEDVETNCEWSAFSCFQKAQLKSANTGNNERIINISIKKLKRKPPSTNAGLQQKHRLTCPSCDSYEKKPPKEFLERFKSLLQKMIHQHLSSRTHGSEDS

SEQ ID NO: 557 - protein, 162 aa, synthetic construct
MRSSPGNMERIVICLMVIFLGTLVHKSSSQGQDLHMIRMRQLIDIVDQLKNYVNDLVPEFLPAPEDVETNCEWSAFSCFQKAQLKSANTGNNERLINVLIKKLKRKPPSTNAGSRQKHRLTCPSCDSYEKKPPKEFLERFKSLLQKMIHQHLSSRTHGSEDS

SEQ ID NO: 558 - protein, 162 aa, synthetic construct
MRSSPGNMERIVICLMVIFLGTLVHKSSSQGQDRHMIRMRQLIDIVDQLTNYVNDLVPEFLPAPEDVETNCEESAFSCFQKAELKSANTGNNERIINVSIKKLKRKPPSTSYGRRQKHRLTCPSCDSYEKKPPKEFLERFKSLLQKMIHQHLSSRTHGSEDS

SEQ ID NO: 559 - protein, 162 aa, synthetic construct
MRSSPGNMERIVICLMVIFLGTLVHKSSSQGQDRHMVRMRQLIDIVDQLKNYVNDLVPEFLPAPEDVETNCEWSAFSCFQKAQLKSANTGNNERIINVSIKKLKRKPPSTEAGSRQKHRLTCPSCDSYEKKPPKEFLERFKSLLQKMIHQHLSSRTHGSEDS

SEQ ID NO: 560 - protein, 162 aa, synthetic construct
MRSSPGNMERIVICLMVIFLGTLVHKSSSQGQDRHMIRMRQLIDIVDQLKNYVNDLVPEFLPAPEDVEDNCEWSAFSCFQKAQLKSANTGNNERIINVSIKKLKRKPPSTNAGRDQKHRLTCPSCDSYEKKPPKEFLERFKSLLQKMIHQHLSSRTHGSEDS

SEQ ID NO: 561 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRGDKHRLTCPSCDSYEKKPPKEFLERFKSLLQKMIHQHLSSRTHGSEDS

SEQ ID NO: 562 - protein, 162 aa, synthetic construct
MRSSPGNMERIVICLMVIFLGTLVHKSSSQGQDRLMIRMRELSDIVDQLKNYVNDLVPEFLPAPEDVETNCEWSAFSCFQKAQLKSANTGSNERIINVSIKKLKRKMPSTNAGRRQKHRLTCPSCDSYEKKPPKEFLERFKSLLQKMIHQHLSSRTHGSEDS

SEQ ID NO: 563 - protein, 162 aa, synthetic construct
MRSSPGNMERIVICLMVIFLGTLVHKSSSQGQDRHMIRMMQLIDIVDQLKNYVNDLVPEFLPAPEDVETNCEWSAFSCFQKAQLKSANTGNNERIINVSIKKLKRKPPSTNAGTRQKHRLTCPSCDSYEKKPPKEFLERFKSLLQKMIHQHLSSRTHGSEDS

SEQ ID NO: 564 - protein, 162 aa, synthetic construct
MRSSPGNMERIVICLMVIFLGTLVHKSSSQGQDRHMIRMRQLIDIVDQLKNYSNDLVPEFLPAPEDVETNCEWSAFSCFQKAQLKSANTGNNERIINVSIKQLKRKPPSINAGRRQKHRLTCPSCDSYEKKPPKEFLERFKSLLQKMIHQHLSSRTHGSEDS

SEQ ID NO: 565 - protein, 162 aa, synthetic construct
MRSSPGNMERIVICLMVIFLGTLVHKSSSQGQDLHMIRMRQLIDIVDQLKNYVNDLVPEFLPAPEDVETNCEWSAFSCFQKAQLKSANTGNNETIINVSIKKLKRKPPSTIAGSRQKHRLTCPSCDSYEKKPPKEFLERFKSLLQKMIHQHLSSRTHGSEDS

SEQ ID NO: 566 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNVYREQKHRLTCPSCDSYEKKPPKEFLERFKSLLQKMIHQHLSSRTHGSEDS

SEQ ID NO: 567 - protein, 162 aa, synthetic construct
MRSSPGNMERIVICLMVIFLGTLVHKSSSQGQDRHMIRLRQLIDIVDQLKNYVNDLVPEFLPAPEDVETNCEWSAFSCFQKAQLKSANTGNNERIINVSIKKLKRKPPSTDAGRRQKHRLTCPSCDSYEKKPPKEFLERFKSLLQKMIHQHLSSRTHGSEDS

SEQ ID NO: 568 - protein, 162 aa, synthetic construct
MRSSPGNMERIVICLMVIFLGTLVHKSSSQGQDRHMIRMRQLIDIVDQLKTYVNDLVPEFLPAPEDVETNCEWSAFSCFQKAQLKSANTGNNERIINSSIKKLKRKPPSTNAGRSQKHRLTCPSCDSYEKKPPKEFLERFKSLLQKMIHQHLSSRTHGSEDS

SEQ ID NO: 569 - protein, 162 aa, synthetic construct
MRSSPGNMERIVICLMVIFLGTLVHKSSSQGQDRHMIRMRQLIDIVDQLKNYVNDLVPEFLPAPEDVETNCVWSAFSCFQKAQLKSANTGNNERIINQSIKKLKRKPPSTNAGWRQKQRNTCPSCDSYEKKPPKEFLERFKSLLQKMIHQHLSSRTHGSEDS

SEQ ID NO: 570 - protein, 162 aa, synthetic construct
MRSSPGNMERIVICLMVIFLGTLVHKSSSQGQVRHMIRMRQLIDIVDQLKNYVNDLVPEFLPAPEDVETNCEWSAFSCFQTAQLKSANTGNNERIINVSIKQLKRKPPSTNAGRRQKHRLTCPSCDSYEKKPPKEFLERFKSLLQKMIHQHLSSRTHGSEDS

SEQ ID NO: 571 - protein, 162 aa, synthetic construct
MRSSPGNMERIVICLMVIFLGTLVHKSSSQGNDRHMIRMRQLIDIVDQLKNYVNDLVPEFLPAPEDVETNCEWSAFSCFQKAQLKSANTGNNERIINVSIKKLKRKPPSTNMGGYQKHRLTCPSCDSYEKKPPKEFLERFKSLLQKMIHQHLSSRTHGSEDS

SEQ ID NO: 572 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGTGQKHRLTCPSCDSYEKKPPKEFLERFKSLLQKMIHQHLSSRTHGSEDS

SEQ ID NO: 573 - protein, 162 aa, synthetic construct
MRSSPGNMERIVICLMVIFLGTLVHKSSSQGQDRHMIRMRQLIDIVDQLKNYVNDLVPEFLPAPEDVETECEWSAFSCFQNAQLKSANTGNNERIINVSIKKLKRKPPSTNAERRQKHRLTCPSCDSYEKKPPKEFLERFKSLLQKMIHQHLSSRTHGSEDS

SEQ ID NO: 574 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVLIKKLKRKPPSTNGGRRQKHVLTCPSCDSYEKKPPKEFLERFKSLLQKMIHQHLSSRTHGSEDS

SEQ ID NO: 575 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQTAQLKSANTGNNERIINLTIKKLKRKPPSTNAGRRQKHRLTCPSCDSYEKKPPKEFLDRFKSLLQKMIKQHLSSRTHGSEDS

SEQ ID NO: 576 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRVQKDRLTCPSCDSYEKKPPKEFLERFKSLLQKMIHQHLSSRTHGSEDS

SEQ ID NO: 577 - protein, 162 aa, synthetic construct
MRSSPGNMERIVICLMVIFLGTLVHKSSSQGQDRHMIRMRQLIDIVDQLSNYVNDLVPEFLPAPEDVETNCEWSAFNCFQKAQLKSANTGNNERIINVSIKKLKRKPPSTNAGGRQKHRLTCPSCDSYEKKPPKEFLERFKSLLQKMIHQHLSSRTHGSEDS

SEQ ID NO: 578 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGTRQKHVLTCPSCDSYEKKPPKEFLERFKSLLQKMIHQHLSSRTHGSEDS

SEQ ID NO: 579 - protein, 162 aa, synthetic construct
MRSSPGNMERIVICLMVIFLGTLVHKSSSQGQDRHMIRMRQLIDIVDQLKNYVNDLVPEFLHAPEDVETNCEWSAFSCFQAAQLKSANTGNNERIINVSIKKLKRKPPSTNAGARQKHRLTCPSCDSYEKKPPKEFLERFKSLLQKMIHQHLSSRTHGSEDS

SEQ ID NO: 580 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSKNTGNNERIINVSIKKLKRKPPSTNASRDQKHRLTCPSCDSYEKKPPKEFLERFKSLLQKMIHQHLSSRTHGSEDS

SEQ ID NO: 581 - protein, 162 aa, synthetic construct
MRSSPGNMERIVICLMVIFLGTLVHKSSSQGNDRHMIRMRQLIDIVDQLKNYVNDLVPEFLPAPEDVETNCEWSAFSCFQKAQLKSANTGNNERIINVSIKKLKRKPPSTNAGGRQKHRLTCPSCDSYEKKPPKEFLERFKSLLQKMIHQHLSSRTHGSEDS

SEQ ID NO: 582 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVTIKKLKRKPPSTNAGREQKHRLTCPSCDSYEKKPPKEFLERFKSLLQKMIHQHLSSRTHGSEDS

SEQ ID NO: 583 - protein, 162 aa, synthetic construct
MRSSPGNMERIVICLMVIFLGTLVHKSSSQGQDREMIRMDQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 584 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGRQKTRLTCPSCDSYEKKPPKEFLERFKSLLQKMIHQHLSSRTHGSEDS

SEQ ID NO: 585 - protein, 162 aa, synthetic construct
MRSSPGNMERIVICLMVIFLGTLVHKSSSQGQDPHMIRMEQLIDIVDQLLNYVNDLVPEFLPAPEDVETNCEWSAFSCFQKAQLKSANTGNEERIINVSIKKLKRKPPSTNAGRGQKHRLTCPSCDSYEKKPPKEFLERFKSLLQKMIHQHLSSRTHGSEDS

SEQ ID NO: 586 - protein, 162 aa, synthetic construct
MRSSPGNMERIVICLMVIFLGTLVHKSSSQGQDRHMIRMIQLIDIVDQLKNYVNDLVPEFLPAPEDVETNCEWSAFSCFQAAQLKSANTGNNERIINVSIKKLKRTPPSTPAGRRQKHRLTCPSCDSYEKKPPKEFLERFKSLLQKMIHQHLSSRTHGSEDS

SEQ ID NO: 587 - protein, 162 aa, synthetic construct
MRSSPGNMERIVICLMVIFLGTLVHKSSSQGDMRAMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 588 - protein, 162 aa, synthetic construct
MRSSPGNMERIVICLMVIFLGTLVHKSSSQGQDRHMIRMRQLIDIVDQLSNYVNDLVPEFLPAPKDVETNCEWSAFSCFQKAQLKSANTGNNERDINVSIKKLKRKPPSTNAGMRQKHRLTCPSCDSYEKKPPKEFLERFKSLLQKMIHQHLSSRTHGSEDS

SEQ ID NO: 589 - protein, 162 aa, synthetic construct
MRSSPGNMERIVICLMVIFLGTLVHKSSSQGQDRHMIRMRQLIDIVDQLSNYVNDLVPEFLPAPEDVETNCEWSAFSCFQKAQLKSANTGNNERIINVSIKKLKREPPSTNAGRRQKHRLTCPSCDSYEKKPPKEFLERFKSLLQKMIHQHLSSRTHGSEDS

SEQ ID NO: 590 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHEQTCPSCDSYEKKPPKEFLERFKSLLQKMIHQHLSSRTHGSEDS

SEQ ID NO: 591 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNLGNRQKQRLTCPSCDSYEKKPPKEFLERFKNLLQKMIHIHLSSRTHGSEDS

SEQ ID NO: 592 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNETIINVSIKKLKRKPPSTNAGYRQKHRLTCPSCDSYEKKPPKEFLERFKSLLQKMIHQHLSSRTHGSEDS

SEQ ID NO: 593 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDTAGRRQKTRLTCPSCDSYEKKPPKEFLERFKSLLQKMIHQHLSSRTHGSEDS

SEQ ID NO: 594 - protein, 162 aa, synthetic construct
MRSSPGNMERIVICLMVIFLGTLVHKSSSQGQDRHMIRMRQLIDIVDQLKNYVNDLTPEFLPAPEDVETNCEWSAFSCFQKAQLKSANTGNNERIINVTIKKLKRKPPSTNSGERQKHRLTCPSCDSYEKKPPKEFLERFKSLLQKMIHQHLSSRTHGSEDS

SEQ ID NO: 595 - protein, 162 aa, synthetic construct
MRSSPGNMERIVICLMVIFLGTLVHKSSSQGQDRHMIRMRQLIDIVDQLKNYVNDLVPEFLPAPEDVMTNCEWSAFSCFQKAQLKSANTGNNERIINVSIKKLKRKPPSTNAGTAQKHRLTCPSCDSYEKKPPKEFLERFKSLLQKMIHQHLSSRTHGSEDS

SEQ ID NO: 596 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINLSIKKLKRKPPSTNADRRQKHRTTCPSCDSYEKKPPKEFLERFKSLLQKMIHQHLSSRTHGSEDS

SEQ ID NO: 597 - protein, 162 aa, synthetic construct
MRSSPGNMERIVICLMVIFLGTLVHKSSSQGQDRTMIRMVQLIDIVDQLKNYVNDLVPEFLPAPEDVETNCEWSAFSCFQKAQLKSANTGNNERIINVSIKKLKRKPPSTNAWRRQKHRLTCPSCDSYEKKPPKEFLERFKSLLQKMIHQHLSSRTHGSEDS

SEQ ID NO: 598 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTDAGRRQKNRLTCPSCDSYEKKPPKEFLERFKSLLQKMIHQHLSSRTHGSEDS

SEQ ID NO: 599 - protein, 162 aa, synthetic construct
MRSSPGNMERIVICLMVIFLGTLVHKSSSQGQDRHMIRMRQLIDIVDELKNYVNDLVPEFLPAPEDVETNCEWSAFSCFQKAQLKSANTGNNERIINISIKKLKRKPPSTSAGQRQKHRLTCPSCDSYEKKPPKEFLERFKSLLQKMIHQHLSSRTHGSEDS

SEQ ID NO: 600 - protein, 162 aa, synthetic construct
MRSSPGNMERIVICLMVIFLGTLVHKSSSQGQDPKMIRMRQLIDIVDQLKNYVNDLVPEFLPAPEDVETNCEWSAFSCFQKAQLKSANTGNNERIINVSIKALKRKPPSTNAGRAQKHRLTCPSCDSYEKKPPKEFLERFKSLLQKMIHQHLSSRTHGSEDS

SEQ ID NO: 601 - protein, 162 aa, synthetic construct
MRSSPGNMERIVICLMVIFLGTLVHKSSSQGQDRHFIRMKQLIDIVDQLKNYVNDLVPELLPAPEDVETNCEWSAFSCFQKAQLKSANTGNNERIINVSIKKLKRKPPSTNEGRRQKHRLTCPSCDSYEKKPPKEFLERFKSLLQKMIHQHLSSRTHGSEDS

SEQ ID NO: 602 - protein, 162 aa, synthetic construct
MRSSPGNMERIVICLMVIFLGTLVHKSSSQGQDRHMIRMRQLIDIVDQLSNYVNDLVPEFLPAPEDVETNCEWSAMSCFQKAQLKSANTGNNERIIGESIKKLKRKPPSTNAGRRQKHRLTCPSCDSYEKKPPKEFLERFKSLLQKMIHQHLSSRTHGSEDS

SEQ ID NO: 603 - protein, 162 aa, synthetic construct
MRSSPGNMERIVICLMVIFLGTLVHKSSSQGQDRHMIRMRQLIDIVDQLKNYVNDLVPEFLPAPEDVETHCEWSAFSCFQKAQLKSANTGNNERIINVSIKKLKRKPPSTNAGTRQKHRGDCPSCDSYEKKPPKEFLERFKSLLQKMIHQHLSSRTHGSEDS

SEQ ID NO: 604 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFLCFQKAQLKSANTGNNERIINDSIKKLKRKPPSTNAGRRQKHRHTCPSCDSYEKKPPKEFLERFKSLLQKMIHQHLSSRTHGSEDS

SEQ ID NO: 605 - protein, 162 aa, synthetic construct
MRSSPGNMERIVICLMVIFLGTLVHKSSSQGQDRHMIRMGQLIDIVDQLKNYVNDLVPEFLPAPEDVETNCEWSAFSCFQKAQLKSANTGNNERIINVSIKKLKRKPPSTNAGERQKHRLTCPSCDSYEKKPPKEFLERFKSLLQKMIHQHLSSRTHGSEDS

SEQ ID NO: 606 - protein, 162 aa, synthetic construct
MRSSPGNMERIVICLMVIFLGTLVHKSSSQGQDRHMIRMRQLIDIVDQLKNYVNDLNPEFLPAPEDVETNCEWSAFSCFQKAQLKSANTGNNERIINVSIKKLKRKPPSTNAGRSQKHRLTCPSCDSYEKKPPKEFLERFKSLLQKMIHQHLSSRTHGSEDS

SEQ ID NO: 607 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVLIKKLKRKPPSTDAGRRSKHRLTCPSCDSYEKKPPKEFLERFKSLLQKMIHQHLSSRTHGSEDS

SEQ ID NO: 608 - protein, 162 aa, synthetic construct
MRSSPGNMERIVICLMVIFLGTLVHKSSSQGQDRHMIFMRQLIDIVDQLSNYVADLVPEFLPAPEDVDTNCEWSAFSCFQAAQLKSANTGNNERIINVSIKKLKRKPPSTNAGRRQKHRLTCPSCDSYEKKPPKEFLERFKSLLQKMIHQHLSSRTHGSEDS

SEQ ID NO: 609 - protein, 162 aa, synthetic construct
MRSSPGNMERIVICLMVIFLGTLVHKSSSQGQDRFMIRMRQLIDIVDQLKNVVNDLLPEFLPAPEDVETNCEWSAFSCFQKAQLKSANTGNNERIINVSIKKLKRKPPSTEAGRRQKHRLTCPSCDSYEKKPPKEFLERFKSLLQKMIHQHLSSRTHGSEDS

SEQ ID NO: 610 - protein, 162 aa, synthetic construct
MRSSPGNMERIVICLMVIFLGTLVHKSSSQGQDRHMIRMRQLIDIVDQLKSYVNDLVPEGLPAPEDVETNCEWSAFSCFQKAQLKSANTGNNERIINVSIQKLKRKPPSTNAGRRQKHRLTCPSCDSYEKKPPKEFLERFKSLLQKMIHQHLSSRTHGSEDS

SEQ ID NO: 611 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINSSIKKLKRKPPSTNAGRGQKHRLTCPSCDSYEKKPPKEFLERFKSLLQKMIHQHLSSRTHGSEDS

SEQ ID NO: 612 - protein, 162 aa, synthetic construct
MRSSPGNMERIVICLMVIFLGTLVHKSSSQGNDRHMIRMRQLIDIVDQLKNYVNDLVPEFLPAPEDVETNCEWSAFSCFQKAQLKSANTGNNERIINVSIKKLKRKPPSTEAGRRQKHRLTCPSCDSYEKKPPKEFLERFKSLLQKMIHQHLSSRTHGSEDS

SEQ ID NO: 613 - protein, 162 aa, synthetic construct
MRSSPGNMERIVICLMVIFLGTLVHKSSSQGQDRHMIRMRQLIDIVDDLSNYVNDLVPEFLPAPGDVETNCEWSAFSCFQKAQLKSANTGNNERIINESIKKLKRKPYSTNAGRRQKHRLTCPSCDSYEKKPPKEFLERFKSLLQKMIHQHLSSRTHGSEDS

SEQ ID NO: 614 - protein, 162 aa, synthetic construct
MRSSPGNMERIVICLMVIFLGTLVHKSSSQGQDRHMIRMRQLIDIVDQLKNYVKDLVPEFLPAPEDVETNCVWSAFSCFQKAQLKSANTGENEAIINVSIKKLKRKPPSTNAERRQKHRLTCPSCDSYEKKPPKEFLERFKSLLQKMIHQHLSSRTHGSEDS

SEQ ID NO: 615 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIISLSIKKLKRKPPSTNAGVRQKHRLTCPSCDSYEKKPPKEFLERFKSLLQKMIHQHLSSRTHGSEDS

SEQ ID NO: 616 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRNKERLTCPSCDSYEKKPPKEFLERFKSLLQKMIHQHLSSRTHGSEDS

SEQ ID NO: 617 - protein, 162 aa, synthetic construct
MRSSPGNMERIVICLMVIFLGTLVHKSSSQGGDRPEIRMRQLIDIVDQLKNYVNDLIPEPLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 618 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIITVSIKKLKRKPPSTNAGRRQKEQLACPSCDSYEKKPPKEFLERFKSLLQKMIHQHLSSRTHGSEDS

SEQ ID NO: 619 - protein, 162 aa, synthetic construct
MRSSPGNMERIVICLMVIFLGTLVHKSSSQGQDRHMIRMRQLIDIVDQLLHYRNDLVPEFLPAPEDVETNCEWSAFSCFQKAQLKSANTGNNERIINVSISKLKRKLPSTNAGRRQKHRLTCPSCDSYEKKPPKEFLERFKSLLQKMIHQHLSSRTHGSEDS

SEQ ID NO: 620 - protein, 162 aa, synthetic construct
MRSSPGNMERIVICLMVIFLGTLVHKSSSQGQDRHMIRMRQLIDIVDQLKNYVNDLVPEFLPAPEDVEMNCEWSAFHCFQKAQLKSANTGNNERIITVSIKQLKRKLPSTNAGRRQKHRLTCPSCDSYEKKPPKEFLERFKSLLQKMIHQHLSSRTHGSEDS

SEQ ID NO: 621 - protein, 162 aa, synthetic construct
MRSSPGNMERIVICLMVIFLGTLVHKSSSQGQDRTMIRMVQLIEIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 622 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNEQTINVSIKKLKRKPPSTIAGRRQKERLTCPSCDSYEKKPPKEFLERFKSLLQKMIHQHLSSRTHGSEDS

SEQ ID NO: 623 - protein, 162 aa, synthetic construct
MRSSPGNMERIVICLMVIFLGTLVHKSSSQGQDRHMIRLRQLIDIVDQLKNYVNDLVPEFLPAPEDVETNCEWSAFSCFQNAQLKSANTGNNERIINVSIKKLKRKPPSTNAGRRQKHRLTCPSCDSYEKKPPKEFLERFKSLLQKMIHQHLSSRTHGSEDS

SEQ ID NO: 624 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKLPSTNAGRRQKHGLTCPSCDSYEKKPPKEFLERFKSLLQKMIHQHLSSRTHGSEDS

SEQ ID NO: 625 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNQRIINVSIKKLKRKPPSTNQGREQKHKLTCPSCDSYEKKPPKEFLERFKSLLQKMIHQTLSSRTHGSEDS

SEQ ID NO: 626 - protein, 162 aa, synthetic construct
MRSSPGNMERIVICLMVIFLGTLVHKSSSQGQDRLMIRMRQLIDIVDQLKNYVNDLVPELLPAPEDVETNCEWSAFSCFQKAQLKSANTGNNERGINVSIKKLKRKPPSTNAITRQKHRLTCPSCDSYEKKPPKEFLERFKSLLQKMIHQHLSSRTHGSEDS

SEQ ID NO: 627 - protein, 162 aa, synthetic construct
MRSSPGNMERIVICLMVIFLGTLVHKSSSQGQDRHMIRMRQLIDIVDQLKEYVNDLVPEELPAPEEVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 628 - protein, 162 aa, synthetic construct
MRSSPGNMERIVICLMVIFLGTLVHKSSSQGQDRHMIRLRQLIDIVDQLKNYVNDLVPEFLPAPEDVETNCEWSAFSCFQKAQLKSANTGNNERIINVSIKKLKRDPPSTNAGRRQKHRLTCPSCDSYEKKPPKEFLERFKSLLQKMIHQHLSSRTHGSEDS

SEQ ID NO: 629 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINISIKKLKRKPPSTNAGRRQKHILECPSCDSYEKKPPKEFLERFKSLLQKMIHQHLSSRTHGSEDS

SEQ ID NO: 630 - protein, 162 aa, synthetic construct
MRSSPGNMERIVICLMVIFLGTLVHKSSSQGPDRVMIRMRQLIDIVDQLKNYVNDLVPEFLPAPEDVETNCEWSAFSCFQKAQLKSANTGNNEQIINVSIKKLKRKPPSTNQGRRQKHRLTCPSCDSYEKKPPKEFLERFKSLLQKMIHQHLSSRTHGSEDS

SEQ ID NO: 631 - protein, 162 aa, synthetic construct
MRSSPGNMERIVICLMVIFLGTLVHKSSSQGQDRHLIRMRQLIDIVDQLKNYVNDLVPEFLPAPEDVETNCEWSAFSCFQKAQLKSANSGTNERIINVSIKKLKRKPPSTNAGRGQKHRLTCPSCDSYEKKPPKEFLERFKSLLQKMIHQHLSSRTHGSEDS

SEQ ID NO: 632 - protein, 162 aa, synthetic construct
MRSSPGNMERIVICLMVIFLGTLVHKSSSQGQDRHMIRMRQLIDIVDQLKNYVEDLVPEFLPAPEDVETNCEWSAFSCFQKAGLKSANTGNNERIINVSIKKLKRKPPSTNAGARQKHRLTCPSCDSYEKKPPKEFLERFKSLLQKMIHQHLSSRTHGSEDS

SEQ ID NO: 633 - protein, 162 aa, synthetic construct
MRSSPGNMERIVICLMVIFLGTLVHKSSSQGQDRHMIRMRQLIDIVDQLKNYVSDLVPEELPAPEDVETVCEWSAFSCFQKAQLKSANTGNNERIINVSIKKLKRKPPSTNAGKEQKHRLTCPSCDSYEKKPPKEFLERFKSLLQKMIHQHLSSRTHGSEDS

SEQ ID NO: 634 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGKGQKHRLTCPSCDSYEKKPPKEFLERFKSLLQKMIHQHLSSRTHGSEDS

SEQ ID NO: 635 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGTRQKHLLTCPSCDSYEKKPPKEFLERFKSLLQKMIHQHLSSRTHGSEDS

SEQ ID NO: 636 - protein, 162 aa, synthetic construct
MRSSPGNMERIVICLMVIFLGTLVHKSSSQGQDRSMIRMRQLIDIVDQLKNYVNDLVPEFLPAPEDVETECEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 637 - protein, 162 aa, synthetic construct
MRSSPGNMERIVICLMVIFLGTLVHKSSSQGQDRQMIRMRQLIDIVDQLKNYVNDLEPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 638 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGTRQKHTLTCPSCDSYEKKPPKEFLERFKSLLQKMIHQHLSSRTHGSEDS

SEQ ID NO: 639 - protein, 162 aa, synthetic construct
MRSSPGNMERIVICLMVIFLGTLVHKSSSQGDDRHMIRMRQLIDIVDQLKNYVNDLVPEFLPAPEDVETNCEWSAFSCFQKAQLKSSNTGNNERIINVSIKKLKRKPPSTNAGRGQKHRLTCPSCDSYEKKPPKEFLERFKSLLQKMIHQHLSSRTHGSEDS

SEQ ID NO: 640 - protein, 162 aa, synthetic construct
MRSSPGNMERIVICLMVIFLGTLVHKSSSQGQDRSMIFMRQLIDIVDQLKNYVNDLVPEFLPAPEDVETNCEWSAFSCFQKAQLKLANTGNNERIINVSIKKLKRKPPSTEPGRRQKHRLTCPSCDSYEKKPPKEFLERFKSLLQKMIHQHLSSRTHGSEDS

SEQ ID NO: 641 - protein, 162 aa, synthetic construct
MRSSPGNMERIVICLMVIFLGTLVHKSSSQGQDRKMIRMRQLIDIVDQLKNYVNDLVPEFLPAPEDVETNCEWSAFSCFQDAQLKSANTGNNERIITVSIKKLKRKPPSTPAGRRQKHRLTCPSCDSYEKKPPKEFLERFKSLLQKMIHQHLSSRTHGSEDS

SEQ ID NO: 642 - protein, 162 aa, synthetic construct
MRSSPGNMERIVICLMVIFLGTLVHKSSSQGQDTHMIRMRQLIDIVDQLKNYVNDLVPEFLPAPEDVETNCEWSAFSCFQKAQLKSANTGNNERIINVSIKKLKRKPPSTEAGVRQKHRLTCPSCDSYEKKPPKEFLERFKSLLQKMIHQHLSSRTHGSEDS

SEQ ID NO: 643 - protein, 162 aa, synthetic construct
MRSSPGNMERIVICLMVIFLGTLVHKSSSQGADRAMIRMRQLIDIVDQLKHYVNDLVPEFLPAPEDVETNCEWSAFSCFQKAQLKSANTGNNERIINASIKKLKRKPPSTNAGRRQKHRLTCPSCDSYEKKPPKEFLERFKSLLQKMIHQHLSSRTHGSEDS

SEQ ID NO: 644 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFTCFQKAQLKSANTGNNERIINVSIKKLKRKPPSTNAGRRQKDRLTCPSCDSYEKKPPKEFLERFKSLLQKMIHQHLSSRTHGSEDS

SEQ ID NO: 645 - protein, 162 aa, synthetic construct
MRSSPGNMERIVICLMVIFLGTLVHKSSSQGQDRHMIRMEQLIDIVDQLKNYVNDLVPEFLPAPEDVETNCEWSAFSCFQKAQLKSANTGNNERIINVSIKKLKRKPPSTNAGQRQKHRLTCPSCDSYEKKPPKEFLERFKSLLQKMIHQHLSSRTHGSEDS

SEQ ID NO: 646 - protein, 162 aa, synthetic construct
MRSSPGNMERIVICLMVIFLGTLVHKSSSQGQDRTMIRMRQLIDIVDQLKNYVNDLVPEFLPAPEDVETNCEWSAFSCFQKAQLKSANTGNNERIINDSIKKLKKKPPSTNAGRRQKHRLTCPSCDSYEKKPPKEFLERFKSLLQKMIHQHLSSRTHGSEDS

SEQ ID NO: 647 - protein, 162 aa, synthetic construct
MRSSPGNMERIVICLMVIFLGTLVHKSSSQGQDRHMIRMLQLISIVDQLKNYVNDLVPEFLPAPEDVETNCEWSAFSCFQKAQLKSANTGNNERIIEVSIKKLKRKPPSTNAGFRQKHRLTCPSCDSYEKKPPKEFLERFKSLLQKMIHQHLSSRTHGSEDS

SEQ ID NO: 648 - protein, 162 aa, synthetic construct
MRSSPGNMERIVICLMVIFLGTLVHKSSSQGQDRHMIRMRQLIDIVDQLKNYVNDLVPEFLPAPEDVEDNCEWSAFSCFQKAQLKSANTGNNERIINVSIKKLKRKPPSTNAGGRQKHRLTCPSCDSYEKKPPKEFLERFKSLLQKMIHQHLSSRTHGSEDS

SEQ ID NO: 649 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLSSANTGNNERIINVSIKKLKRKPPATNAGARQKHRNTCPSCDSYEKKPPKEFLERFKSLLQKMIKQHLSSRTHGSEDS

SEQ ID NO: 650 - protein, 162 aa, synthetic construct
MRSSPGNMERIVICLMVIFLGTLVHKSSSQGQDRGMIRMRQLIDIVDQLKNYVNDLVPEFLPAPEDVETNCEWSAFSCFQKAQLKSANTGNNETIINVSIKKLKRKPPSTNAGRRQKHRLTCPSCDSYEKKPPKEFLERFKSLLQKMIHQHLSSRTHGSEDS

SEQ ID NO: 651 - protein, 162 aa, synthetic construct
MRSSPGNMERIVICLMVIFLGTLVHKSSSQGPDRHMIRMRQLIDIVDQLKNYVNDLVPEELPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 652 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKNTLTCPSCDSYEKKPPKEFLERFKSLLQKMIHQHLSSRTHGSEDS

SEQ ID NO: 653 - protein, 162 aa, synthetic construct
MRSSPGNMERIVICLMVIFLGTLVHKSSSQGQDRSLIRMRQLIDIVDQLKNYVNDLVEEFLPAPEDVETNCEWSAFSCFQKAQLKSANTGNNERIINVSIKKLARKPPSTNAGHRQKHRLTCPSCDSYEKKPPKEFLERFKSLLQKMIHQHLSSRTHGSEDS

SEQ ID NO: 654 - protein, 162 aa, synthetic construct
MRSSPGNMERIVICLMVIFLGTLVHKSSSQGQDRHMYRMRQLIDIVDQLKHYVNDLVPEFLPAPEKVETNCEWSAFSCFQKAQLKSANTGNNERIINESIKKLKRTPPSTNAGRRQKHRLTCPSCDSYEKKPPKEFLERFKSLLQKMIHQHLSSRTHGSEDS

SEQ ID NO: 655 - protein, 162 aa, synthetic construct
MRSSPGNMERIVICLMVIFLGTLVHKSSSQGQDRSMIRMRQLIDIVDQLGNYVNDLVPENYPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 656 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGTRQKNRLTCPSCDSYEKKPPKEFLERFKSLLQKMIHQHLSSRTHGSEDS

SEQ ID NO: 657 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTSAGRRQKHELTCPSCDSYEKKPPKEFLERFKSLLQKMIHQHLSSRTHGSEDS

SEQ ID NO: 658 - protein, 162 aa, synthetic construct
MRSSPGNMERIVICLMVIFLGTLVHKSSSQGQDRHMIRMKQLIDIVDQLKNYVNDLVPEFLPAPEDVETNCEWSAFSCFQKAQLKSANTGENERIINVSIKKLKRKPPSTNAGRRQKHRLTCPSCDSYEKKPPKEFLERFKSLLQKMIHQHLSSRTHGSEDS

SEQ ID NO: 659 - protein, 162 aa, synthetic construct
MRSSPGNMERIVICLMVIFLGTLVHKSSSQGQDRVMIRMRQLIDIVDQLGNYVNDLVPEFLPAPEDVEENCEWSAFSCFQKATLKSANTGNNERIINVGIKKLKRKPPSTNAGRRQKHRLTCPSCDSYEKKPPKEFLERFKSLLQKMIHQHLSSRTHGSEDS

SEQ ID NO: 660 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIITVSIKKLKRKPPSTNAGVFQKHRLTCPSCDSYEKKPPKEFLERFKSLLQKMIHQHLSSRTHGSEDS

SEQ ID NO: 661 - protein, 162 aa, synthetic construct
MRSSPGNMERIVICLMVIFLGTLVHKSSSQGQDRHMIRMRQLIDIVDQLENYVNDLVPEFLPAPEDVETNCEWSAFSCFQKAQLKSANTGNNERIINVSIKKLKRKPPSTQAGRGQKHRLTCPSCDSYEKKPPKEFLERFKSLLQKMIHQHLSSRTHGSEDS

SEQ ID NO: 662 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPATNAGREQKHRLTCPSCDSYEKKPPKEFLERFKSLLQKMIHQHLSSRTHGSEDS

SEQ ID NO: 663 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNETIINVSIKKLKRKPPPTNAGRRQKHRLTCPSCDSYEKKPPKEFLERFKSLLQKMIHQHLSSRTHGSEDS

SEQ ID NO: 664 - protein, 162 aa, synthetic construct
MRSSPGNMERIVICLMVIFLGTLVHKSSSQGQDRHMIRMRQLIDIVDQLKNYVNDLVPEFLPAPEDVETECEWSAFSCFQKAQLKSANTGNNERIINVSIKKLKRKPPSTNAGSRQKHRLTCPSCDSYEKKPPKEFLERFKSLLQKMIHQHLSSRTHGSEDS

SEQ ID NO: 665 - protein, 162 aa, synthetic construct
MRSSPGNMERIVICLMVIFLGTLVHKSSSQGQERTIIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 666 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVTIKKLKRKPPSTNAGRVQKHRLTCPSCDSYEKKPPKEFLERFKSLLQKMIHQHLSSRTHGSEDS

SEQ ID NO: 667 - protein, 162 aa, synthetic construct
MRSSPGNMERIVICLMVIFLGTLVHKSSSQGQDRAMIRMRQLIDIVDQLKNYVNDLVPEFLPAPEDVEDNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 668 - protein, 162 aa, synthetic construct
MRSSPGNMERIVICLMVIFLGTLVHKSSSQGQDRHMIFMRQLIDIVDQLKNYVNDLVPEFLPAPEDVETHCEWSAFSCFQKAQLKSANTGNNERIINVDIKKLKRKPPSTNAGRAQKHRLTCPSCDSYEKKPPKEFLERFKSLLQKMIHQHLSSRTHGSEDS

SEQ ID NO: 669 - protein, 162 aa, synthetic construct
MRSSPGNMERIVICLMVIFLGTLVHKSSSQGQDRHMERMRQLIDIVDQLKNYVNDLVPEFLPAPEDVETNCEWSAFSCFQLAQLKSANTGNNEQIINVSIKKLKRKPPSTNAGRPQKHRLTCPSCDSYEKKPPKEFLERFKSLLQKMIHQHLSSRTHGSEDS

SEQ ID NO: 670 - protein, 162 aa, synthetic construct
MRSSPGNMERIVICLMVIFLGTLVHKSSSQGQDRHTIRMRQLIDIVDQLKNYVNDLVPEFLPAPEDVETNCEWSAFSCFQKAELKSANTGNNERIINVSIKKLKRKPPSTNAGRRQKHRLTCPSCDSYEKKPPKEFLERFKSLLQKMIHQHLSSRTHGSEDS

SEQ ID NO: 671 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNGGNRQKHRLTCPSCDSYEKKPPKEFLERFKSLLQKMIHQHLSSRTHGSEDS

SEQ ID NO: 672 - protein, 162 aa, synthetic construct
MRSSPGNMERIVICLMVIFLGTLVHKSSSQGQDRHMIRMTQLIDIVDQLKNYVNDLVPEFLPAPEDVETNCEWSAFSCFQKAQLKSANTGNNERIINVSIKKLKRKPPSTNAGVRQKHRLTCPSCDSYEKKPPKEFLERFKSLLQKMIHQHLSSRTHGSEDS

SEQ ID NO: 673 - protein, 162 aa, synthetic construct
MRSSPGNMERIVICLMVIFLGTLVHKSSSQGQERIMIRMRQMIDIVDQLKNYVNDLVPEFLPAPEDVETNCYWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 674 - protein, 162 aa, synthetic construct
MRSSPGNMERIVICLMVIFLGTLVHKSSSQGQDDSMIRMRQLIDIVDQLKNYVNDLVPETLPAPEDVETNCEWSAFSCFQKAQLKSAKTGNNEEIINVSIKKLKRKPPSTNAGRRQKHRLTCPSCDSYEKKPPKEFLERFKSLLQKMIHQHLSSRTHGSEDS

SEQ ID NO: 675 - protein, 162 aa, synthetic construct
MRSSPGNMERIVICLMVIFLGTLVHKSSSQGQDRTMIRMRQLIDIVDQLKNYVNDLVPEFLPAPEDVETNCEWSAFSCFQKAQLKSANTGNNERIINVSIKKLKRKPPITNAGRRQKHRLTCPSCDSYEKKPPKEFLERFKSLLQKMIHQHLSSRTHGSEDS

SEQ ID NO: 676 - protein, 162 aa, synthetic construct
MRSSPGNMERIVICLMVIFLGTLVHKSSSQGQDRGMIRMEQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 677 - protein, 162 aa, synthetic construct
MRSSPGNMERIVICLMVIFLGTLVHKSSSQGQDPHMIRMRQLIDIVDQLKNYVNDLVPEFLPAPEDVETNCEWSAFSCFQKAQLKSANTGNNERIINVAIKKLKRKPPSTNEGRRQKHRLTCPSCDSYEKKPPKEFLERFKSLLQKMIHQHLSSRTHGSEDS

SEQ ID NO: 678 - protein, 162 aa, synthetic construct
MRSSPGNMERIVICLMVIFLGTLVHKSSSQGMDRHMIRMRQLIDIVDQLKNYVNDLVPEFLPAPEDVETNCDWSAFSCFQKAQLKSANTGNNERIINVIIKKLKRKPPSTNAGRMQKHRLTCPSCDSYEKKPPKEFLERFKSLLQKMIHQHLSSRTHGSEDS

SEQ ID NO: 679 - protein, 162 aa, synthetic construct
MRSSPGNMERIVICLMVIFLGTLVHKSSSQGQHRHMIRMRQLIDIVDQLSNYVNDLVPEFLPAPEDVETNCEWSAFSCFQKAELKSANTGNNERIINVSIKKLKRKPPSTNAGNRQKHRLTCPSCDSYEKKPPKEFLERFKSLLQKMIHQHLSSRTHGSEDS

SEQ ID NO: 680 - protein, 162 aa, synthetic construct
MRSSPGNMERIVICLMVIFLGTLVHKSSSQGQDRGMIRMRQLIDIVDQLKNYVNDLVPEFLPAPEDVETNCEWSAFSCFQKAQLKSANTGNNERIINQSIKKLKRKPPSTNAGRRQKHRLTCPSCDSYEKKPPKEFLERFKSLLQKMIHQHLSSRTHGSEDS

SEQ ID NO: 681 - protein, 162 aa, synthetic construct
MRSSPGNMERIVICLMVIFLGTLVHKSSSQGQDRHMIRMRQLIDIVDQLKNYVNDLVPEFLPAPEDVETECEWSAFSCFQKAQLKSANTGNNETIINVSIKKLKRKPPSTNAGRRQKHRLTCPSCDSYEKKPPKEFLERFKNLLQKMIHQHLSSRTHGSEDS

SEQ ID NO: 682 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNEEIIKVSIKKLKRKTPSTNAGRRQKHILTCPSCDSYEKKPPKEFLERFKSLLQKMIHQRLSSRTHGSEDS

SEQ ID NO: 683 - protein, 162 aa, synthetic construct
MRSSPGNMERIVICLMVIFLGTLVHKSSSQGQDRHMIRMKQLIDIVDQLKNYVNDLVPEFLPAPEDVETNCEWSAFSCFQKAQLKSANTGKNERIINVSIKKLKRTPPSTNAGGRQKHRLTCPSCDSYEKKPPKEFLERFKSLLQKMIHQHLSSRTHGSEDS

SEQ ID NO: 684 - protein, 162 aa, synthetic construct
MRSSPGNMERIVICLMVIFLGTLVHKSSSQGQDRHMIRMRQLIDIVDQLKHYVNDLDPEFLPAPEDVETNCEWSAFSCFQKAQLKSANTGNNERIINSSIKKLKRKPPSTNAGRRQKHRLTCPSCDSYEKKPPKEFLERFKSLLQKMIHQHLSSRTHGSEDS

SEQ ID NO: 685 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRGQKHRSTCPSCDSYEKKPPKEFLERFKSLLQKMIHHHLSSRTHGSEDS

SEQ ID NO: 686 - protein, 162 aa, synthetic construct
MRSSPGNMERIVICLMVIFLGTLVHKSSSQGQDRHMIRMRQLIDIVDQLKEYVNDLVPEFLPAPEDVETNCEWSAFSCFQKAQLKSANTGNNERIINVSIKKLKRKPPSTNAGARQKHRLTCPSCDSYEKKPPKEFLERFKSLLQKMIHQHLSSRTHGSEDS

SEQ ID NO: 687 - protein, 162 aa, synthetic construct
MRSSPGNMERIVICLMVIFLGTLVHKSSSQGQDRHMIRMRQLIDIVDQLKNYVNDLVPEFLPAPEDVGENCEWSAFSCFQKAQLKSANTGNNERIINVAIKKLKRKPPSTNVGRRQKHRLTCPSCDSYEKKPPKEFLERFKSLLQKMIHQHLSSRTHGSEDS

SEQ ID NO: 688 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGLRQKHTLTCPSCDSYEKKPPKEFLERFKSLLQKMIHQHLSSRTHGSEDS

SEQ ID NO: 689 - protein, 162 aa, synthetic construct
MRSSPGNMERIVICLMVIFLGTLVHKSSSQGQVRPMIRMRQLIDIVDQLKNYINDLVPEFLPAPEDVETNCEWSAFSCFQKAQLKSANTGNNERIINVSIEKLKRKPPSTNAGARQKHRLTCPSCDSYEKKPPKEFLERFKSLLQKMIHQHLSSRTHGSEDS

SEQ ID NO: 690 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRRKKHEYTCPSCDSYEKKPPKEFLERFKSLLQKMIHQHLSSRTHGSEDS

SEQ ID NO: 691 - protein, 162 aa, synthetic construct
MRSSPGNMERIVICLMVIFLGTLVHKSSSQGQNRHTIRMRQLIDIVDQLKNYVNDLGPEFLPAPEDVETNCEWSAFSCFQKAQLKSANTGNNERIINVSIEKLKRKPPSTNLGRRQKHRLTCPSCDSYEKKPPKEFLERFKSLLQKMIHQHLSSRTHGSEDS

SEQ ID NO: 692 - protein, 162 aa, synthetic construct
MRSSPGNMERIVICLMVIFLGTLVHKSSSQGQDRHMIRMRQLIDIVDQLKNSVNDLVPEFLPAPQDVETNCEWSAFSCFQKAQLKSANTGNNERIIEVSIKQLKRKPPSTNAGRRQKHRLTCPSCDSYEKKPPKEFLERFKSLLQKMIHQHLSSRTHGSEDS

SEQ ID NO: 693 - protein, 162 aa, synthetic construct
MRSSPGNMERIVICLMVIFLGTLVHKSSSQGQDRHMIRMRQLIDIVDQLKNYVNDLVPEFLPAPEDVETECEWSAFSCFQKAQLKSANTGENERIINVSIKKLKRKPPSTNAGRRQKHKLTCPSCDSYEKKPPKEFLERFKSLLQKMIHQHLSSRTHGSEDS

SEQ ID NO: 694 - protein, 162 aa, synthetic construct
MRSSPGNMERIVICLMVIFLGTLVHKSSSQGQDRHMIRMRQLIDIVDQLSNYVNDLVPEFLPAPEDVETNCEWSAFSCFQKAQLKSANTGNNERIINVSIKKLKRKIPSTNAGRRQKHRLTCPSCDSYEKKPPKEFLERFKSLLQKMIHQHLSSRTHGSEDS

SEQ ID NO: 695 - protein, 162 aa, synthetic construct
MRSSPGNMERIVICLMVIFLGTLVHKSSSQGQNRHMIRMRQLIDIVDQLKNYVNDLVPEFLPAPEDVETNCEWSAFSCFQKAQLKSANTGNNERIINVSIKKLKRKPPSTNAGREQKHRLTCPSCDSYEKKPPKEFLERFKSLLQKMIHQHLSSRTHGSEDS

SEQ ID NO: 696 - protein, 162 aa, synthetic construct
MRSSPGNMERIVICLMVIFLGTLVHKSSSQGQDRHMIRMRQLIDIVDQLKNMVNDLVPEFLPAPEDVETNCEWSAFSCFQKAQLKSANTGNNERIINVAIKKLKRKPPSTTAGRRQKHRLTCPSCDSYEKKPPKEFLERFKSLLQKMIHQHLSSRTHGSEDS

SEQ ID NO: 697 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKLPSTNLGRRQKHTLTCPSCDSYEKKPPKEFLERFKSLLQKMIHQHLSSRTHGSEDS

SEQ ID NO: 698 - protein, 162 aa, synthetic construct
MRSSPGNMERIVICLMVIFLGTLVHKSSSQGQDRHMIRMRQLIDIVDQLKNYVNDLVPELLPAPEDVETNCEWSAFSCFQKAQLKSANTGNNERIINVSIKKLKRKPPSTEAGRRQKHRLTCPSCDSYEKKPPKEFLERFKSLLQKMIHQHLSSRTHGSEDS

SEQ ID NO: 699 - protein, 162 aa, synthetic construct
MRSSPGNMERIVICLMVIFLGTLVHKSSSQGQDRVMIRMRQLIDIVDQLGNYVNDLVPEFLPAPEDVETNCEWSAFSCFQKAQLKSANTGNNERIINVSIKKLKRKPPSTNQGRRQKHRLTCPSCDSYEKKPPKEFLERFKSLLQKMIHQHLSSRTHGSEDS

SEQ ID NO: 700 - protein, 162 aa, synthetic construct
MRSSPGNMERIVICLMVIFLGTLVHKSSSQGQDRTAIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 701 - protein, 162 aa, synthetic construct
MRSSPGNMERIVICLMVIFLGTLVHKSSSQGQDRLMIRMRQLIDIVDQLKNYVNDLVPEFLPAPEDVETNCEWSAFSCFQKAQLKSANTGNNERIINVTIKKLKRKPPSTNAGRRQKHRLTCPSCDSYEKKPPKEFLERFKSLLQKMIHQHLSSRTHGSEDS

SEQ ID NO: 702 - protein, 162 aa, synthetic construct
MRSSPGNMERIVICLMVIFLGTLVHKSSSQGQDRHMIRMRQLIDIVDSLLNYVNDLVHEFLPAPEDVETNCEWSAFSCFQNAQLKSANTGNNERNINVSIKKLKRKPPSTNAGRRQKHRLTCPSCDSYEKKPPKEFLERFKSLLQKMIHQHLSSRTHGSEDS

SEQ ID NO: 703 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTSAGRDQKHRLTCPSCDSYEKKPPKEFLERFKSLLQKMIHQHLSSRTHGSEDS

SEQ ID NO: 704 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNEQIINVSIKKLKRKPPSTNAGRRQKHRSTCPSCDSYEKKPPKEFLERFKSLLQKMIHQHLSSRTHGSEDS

SEQ ID NO: 705 - protein, 162 aa, synthetic construct
MRSSPGNMERIVICLMVIFLGTLVHKSSSQGQDRHMIRMRQMIDIVDQLSNYVNDLVPEFLPAPEDVETNCEWPAFSCFQKAQLKSAITGNNERIINVSIKKLKRKPPSTNAGERQKHRLTCPSCDSYEKKPPKEFLERFKSLLQKMIHQHLSSRTHGSEDS

SEQ ID NO: 706 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPDSTDAGRRQKQRLTCPSCDSYEKKPPKEFLERFKSLLQKMIHQHLSSRTHGSEDS

SEQ ID NO: 707 - protein, 162 aa, synthetic construct
MRSSPGNMERIVICLMVIFLGTLVHKSSSQGQDRHMIRMRQLISIVDQLKVYVNDLVPEFLPAPEDVETNCEWSAFSCFQKAQLKSANTGNNERIINVSIEKLKRKPPSTNAGRRQKHRLTCPSCDSYEKKPPKEFLERFKSLLQKMIHQHLSSRTHGSEDS

SEQ ID NO: 708 - protein, 162 aa, synthetic construct
MRSSPGNMERIVICLMVIFLGTLVHKSSSQGQDRHMIRMRQLIDIVDQLKEYVSDLVPEFLPAPEDVETNCEWSAFSCFQKAQLKSANTGNNENIINVSIKKLKRKPPSTNAGRRQKHRLTCPSCDSYEKKPPKEFLERFKSLLQKMIHQHLSSRTHGSEDS

SEQ ID NO: 709 - protein, 162 aa, synthetic construct
MRSSPGNMERIVICLMVIFLGTLVHKSSSQGQDRHMIRMRQLIDIVDQLKNYVEDLVPEELPAPEDVETNCEWSAFSCFQKAQLKSANTGNNERIINVSIKKLKRKPPSTAAGRRQKHRLTCPSCDSYEKKPPKEFLERFKSLLQKMIHQHLSSRTHGSEDS

SEQ ID NO: 710 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGDRQKHRLKCPSCDSYEKKPPKEFLERFKSLLQKMIHQHLSSRTHGSEDS

SEQ ID NO: 711 - protein, 162 aa, synthetic construct
MRSSPGNMERIVICLMVIFLGTLVHKSSSQGQDRLMIRMRQLIDIVDQLKNYVNDLVPEFLPAPEDVETNCEWSAFSCFQKAQLKSANTGNNEKIINVSIKKLKRKPPSTNAGRRQKHRLTCPSCDSYEKKPPKEFLERFKSLLQKMIHQHLSSRTHGSEDS

SEQ ID NO: 712 - protein, 162 aa, synthetic construct
MRSSPGNMERIVICLMVIFLGTLVHKSSSQGQDRHMIRMEQLVDIVDQLKNYVNDLVPEFLPAPEDVETNCEWSAFSCFQKAQLKSANTGNNERIINVSIKKLKRKPPSTNADRRQKHRLTCPSCDSYEKKPPKEFLERFKSLLQKMIHQHLSSRTHGSEDS

SEQ ID NO: 713 - protein, 162 aa, synthetic construct
MRSSPGNMERIVICLMVIFLGTLVHKSSSQGQDRFMIRMRQLIDIVDQLKNYVNDLQPEFLPAPEDVEQNCEWSAFSCFQKAQLKSANTGNNERIINVSIKKLKRKPPSTPAGRRQKHRLTCPSCDSYEKKPPKEFLERFKSLLQKMIHQHLSSRTHGSEDS

SEQ ID NO: 714 - protein, 162 aa, synthetic construct
MRSSPGNMERIVICLMVIFLGTLVHKSSSQGQDRNMIRMRQLIDIVDQLKNYVNDLVPEFLPAPEDVKTNCEWSAFSCFQKAQLKSANTGNNERIINVSIKKLKRKPPSTNAGRQQKHRLTCPSCDSYEKKPPKEFLERFKSLLQKMIHQHLSSRTHGSEDS

SEQ ID NO: 715 - protein, 162 aa, synthetic construct
MRSSPGNMERIVICLMVIFLGTLVHKSSSQGQDRHMIRMRQLIDTVDQLKNYVNDLVPEFLPAPVDVETNCEWSAFSCFQKAQLKSANTGNNERIINVSIKKLKRKPPSTNAGTRQKHRLTCPSCDSYEKKPPKEFLERFKSLLQKMIHQHLSSRTHGSEDS

SEQ ID NO: 716 - protein, 162 aa, synthetic construct
MRSSPGNMERIVICLMVIFLGTLVHKSSSQGFGRHMIRMRQLIDIVDQLKNYVNDLVPEFLPAPEDVETNCEWSAFSCFQKAQLKSANTGNNERIINVLIKKLKRKPPSTNAGRAQKHRLTCPSCDSYEKKPPKEFLERFKSLLQKMIHQHLSSRTHGSEDS

SEQ ID NO: 717 - protein, 162 aa, synthetic construct
MRSSPGNMERIVICLMVIFLGTLVHKSSSQGQDRHMIRMRQLIDIVDQLKHYVNDLVPEFLPAPEDVETNCEWSAFSCFQKAQLKSANTGNNERIINVSIKKLKRKPPSTNAGLRQKHRLTCPSCDSYEKKPPKEFLERFKSLLQKMIHQHLSSRTHGSEDS

SEQ ID NO: 718 - protein, 162 aa, synthetic construct
MRSSPGNMERIVICLMVIFLGTLVHKSSSQGQDRHMIRMRQLIDIVDQLKNYVNDLVPEFLPAPEDVETNCEWSALSCFQKAQLKSANTGNNERIINVSIKKLKRKPPSTNAGRRQKERLTCPSCDSYEKKPPKEFLERFKSLLQKMIHQHLSSRTHGSEDS

SEQ ID NO: 719 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLSRKPPSTNAKARQKHRLTCPSCDSYEKKPPKEFLERFKSLLQKMIHQHLSSRTHGSEDS

SEQ ID NO: 720 - protein, 162 aa, synthetic construct
MRSSPGNMERIVICLMVIFLGTLVHKSSSQGQDRHMIRMRQLIDIVDQLKSYVNDLVPEFLPAPEDVETNCEWSAFSCFQKAQLKSANTGNNERIINVSIKKLKRKPPSTNAGIRQKHRLTCPSCDSYEKKPPKEFLERFKSLLQKMIHQHLSSRTHGSEDS

SEQ ID NO: 721 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGAQKHRLTCPSCDSYEKKPPKEFLERFKSLLQKMIHQHLSSRTHGSEDS

SEQ ID NO: 722 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTYAGRRQKDRLTCPSCDSYEKKPPKEFLERFKSLLQKMIHQHLSSRTHGSEDS

SEQ ID NO: 723 - protein, 162 aa, synthetic construct
MRSSPGNMERIVICLMVIFLGTLVHKSSSQGDDRHMIRMRQLIDIVDQLKNYVNDLVPEFLPAPEDVETNCEWSAFSCFQKAQLKSANTGNNERIINVSIKKLKRKTPSTNAGRRQKHRLTCPSCDSYEKKPPKEFLERFKSLLQKMIHQHLSSRTHGSEDS

SEQ ID NO: 724 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKTPSTIAGRAQKHRLTCPSCDSYEKKPPKEFLERFKSLLQKMINQHLSSRTHGSEDS

SEQ ID NO: 725 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTLAGTRQKHRVNCPSCDSYEKKPPKEFLERFKSLLQKMIHQHYSSRTHGSEDS

SEQ ID NO: 726 - protein, 162 aa, synthetic construct
MRSSPGNMERIVICLMVIFLGTLVHKSSSQGQDRHMIRMRQLIDIVDQLKNYVNDLVPEFLPAPEDVETNCESSAFSCFQKAQLKSANTGNNERIIEVSIKKLKRKLPSTNAGRRQKHRLTCPSCDSYEKKPPKEFLERFKSLLQKMIHQHLSSRTHGSEDS

SEQ ID NO: 727 - protein, 162 aa, synthetic construct
MRSSPGNMERIVICLMVIFLGTLVHKSSSQGQSRHMIRMRQLIDIVDQLKNYVNDLVPEFLPAPEDVETNCEWSAFSCFQKAQLKSANTGNNERIINVSIKKLKRKPPSTNYGREQKHRLTCPSCDSYEKKPPKEFLERFKSLLQKMIHQHLSSRTHGSEDS

SEQ ID NO: 728 - protein, 162 aa, synthetic construct
MRSSPGNMERIVICLMVIFLGTLVHKSSSQGQDRSMIRMRQLADIVDQLKNYVNDLVPEFLPAPEDVETNCEWSAFSCFQKAQLKSANTGNNERIINGIIKKLKRKPPSTAAGRRQKHRLTCPSCDSYEKKPPKEFLERFKSLLQKMIHQHLSSRTHGSEDS

SEQ ID NO: 729 - protein, 162 aa, synthetic construct
MRSSPGNMERIVICLMVIFLGTLVHKSSSQGQDRHMIRMRQLIDIVDQLKNYVNDLVPEFLPAPQDVETNCEWSAFSCFQKAQLKSANTGNNERIINVSIKKLKRKPPSTNASARQKHRLTCPSCDSYEKKPPKEFLERFKSLLQKMIHQHLSSRTHGSEDS

SEQ ID NO: 730 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRGQKHHLTCPSCDSYEKKPPKEFLERFKSLLQKMIHQHLSSRTHGSEDS

SEQ ID NO: 731 - protein, 162 aa, synthetic construct
MRSSPGNMERIVICLMVIFLGTLVHKSSSQGQDRHMIRMRQLIDIVDQLKNYVNDLVPEFLPAPEDVETNCEDSAFSCFQKAQLKSANTGNNERIINVSIKKLKRKPPSTNAGREQKHRLTCPSCDSYEKKPPKEFLERFKSLLQKMIHQHLSSRTHGSEDS

SEQ ID NO: 732 - protein, 162 aa, synthetic construct
MRSSPGNMERIVICLMVIFLGTLVHKSSSQGQDRHMIRMKSLIDIVDQLKNYVNDLVPEDLPAPEDVETNCEWSAFSCFQKAQLKSANTGNNERIINVSIKKLKRKDPSTNAGRRQKHRLTCPSCDSYEKKPPKEFLERFKSLLQKMIHQHLSSRTHGSEDS

SEQ ID NO: 733 - protein, 162 aa, synthetic construct
MRSSPGNMERIVICLMVIFLGTLVHKSSSQGEDRHMIRMRQLIDIVDQLKNYVNDLVPEFLPAPEDVETHCEWSAFSCFQKAQLKSANTGNNERIINVSIKKLKRKMPSTNAGRRQKHRLTCPSCDSYEKKPPKEFLERFKSLLQKMIHQHLSSRTHGSEDS

SEQ ID NO: 734 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSTNAGRNQKHRLTCPSCDSYEKKPPKEFLERFKSLLQKMIHQHLSSRTHGSEDS

SEQ ID NO: 735 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGSNERIINVSIKKLKRKPPPTNAGPRQKHRLSCPSCDSYEKKPPKEFLERFKSLLQKMIHQHLSSRTHGSEDS

SEQ ID NO: 736 - protein, 162 aa, synthetic construct
MRSSPGNMERIVICLMVIFLGTLVHKSSSQGQDRHMIRMRQLIDIVDQLKNYVNDLVPEFLPAPEDVETECEWSAFSCFQKAQLKSANTGNNEAIINVSIKKLKRKPPSTNAKRRQKHRLTCPSCDSYEKKPPKEFLERFKSLLQKMIHQHLSSRTHGSEDS

SEQ ID NO: 737 - protein, 162 aa, synthetic construct
MRSSPGNMERIVICLMVIFLGTLVHKSSSQGQDRHMIRMRQLIHIVDQLKNYVNDLVPEFLPAPEDVETNCEWSAFSCFQKAQLKSANTGNNEDIINVSIKKLKRKPPSTNAGRRQKHRLTCPSCDSYEKKPPKEFLERFKSLLQKMIHQHLSSRTHGSEDS

SEQ ID NO: 738 - protein, 162 aa, synthetic construct
MRSSPGNMERIVICLMVIFLGTLVHKSSSQGQDRFMIRMRQLIDIVDQLKSYVNDLVPEFLPAPESVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 739 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRGQKHRLTCPSCDSYEKKPPKEFLERFKSLLQKMIHQHQSSRTHGSEDS

SEQ ID NO: 740 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTKAGRDQKHRLTCPSCDSYEKKPPKEFLERFKSLLQKMIHQHLSSRTHGSEDS

SEQ ID NO: 741 - protein, 162 aa, synthetic construct
MRSSPGNMERIVICLMVIFLGTLVHKSSSQGLDRHMIRMRQLIDIVDQLKNYVNDLVPEFLPAPEDVETNCEWSAFSCFQKAQLKSANTGNNERIINQSIKKLKRKPPSTNAGRRQKHRLTCPSCDSYEKKPPKEFLERFKSLLQKMIHQHLSSRTHGSEDS

SEQ ID NO: 742 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINISIKKLKRKPPATNAERRQKHRLTCPSCDSYEKKPPKEFLERFKSLLQKMIHQHLSSRTHGSEDS

SEQ ID NO: 743 - protein, 162 aa, synthetic construct
MRSSPGNMERIVICLMVIFLGTLVHKSSSQGLDRFMIRMRQLIDIVDQLKNYVNDLVPEFLPAPEDVERNCEWSAFSCFQKAQLKSANTGNNEAIINVSIKKLKRKPPSTNAGRRQKHRLTCPSCDSYEKKPPKEFLERFKSLLQKMIHQHLSSRTHGSEDS

SEQ ID NO: 744 - protein, 162 aa, synthetic construct
MRSSPGNMERIVICLMVIFLGTLVHKSSSQGDDRHMIRMRQLIDIVDQLKSYVNDLVPEFLPAPEDVETNCEWSAFSCFQKAQLKSANTGNNERIINVSIKKLKRTPPSTNAGRRQKHRLTCPSCDSYEKKPPKEFLERFKSLLQKMIHQHLSSRTHGSEDS

SEQ ID NO: 745 - protein, 162 aa, synthetic construct
MRSSPGNMERIVICLMVIFLGTLVHKSSSQGQDRHMIRMRQLIDIVDQLKNYVNDLDPEFLPAPEDVETNCEWSAFSCFQKAQLKSANTGNNERIINVSIKKLKRKPPSTNADRRQKHRLTCPSCDSYEKKPPKEFLERFKSLLQKMIHQHLSSRTHGSEDS

SEQ ID NO: 746 - protein, 162 aa, synthetic construct
MRSSPGNMERIVICLMVIFLGTLVHKSSSQGQDRAMIRMRQLIDIVDQLKNYVNDLVPEFLPAPEDVETNCELSAFSCFQKAQLKSANTGTNERIINVSIKKLKRKLPSTNAGRRQKHRLTCPSCDSYEKKPPKEFLERFKSLLQKMIHQHLSSRTHGSEDS

SEQ ID NO: 747 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTTAGRAQKHRLTCPSCDSYEKKPPKEFLERFKSLLQKMIHQHLSSRTHGSEDS

SEQ ID NO: 748 - protein, 162 aa, synthetic construct
MRSSPGNMERIVICLMVIFLGTLVHKSSSQGQDRHMIRMRQLITIVDQLKNYVNDLVPEFLPAPEDVETNCEWSAFSCFQKAQLKSANTGNNERIINDSIKKLKRRPPSTNALRRQKHRLTCPSCDSYEKKPPKEFLERFKSLLQKMIHQHLSSRTHGSEDS

SEQ ID NO: 749 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANAGNNERIINVSIKKLKRKPPSTNAGRRQKDRLTCPSCDSYEKKPPKEFLERFKSLLQKMIHQHLSSRTHGSEDS

SEQ ID NO: 750 - protein, 162 aa, synthetic construct
MRSSPGNMERIVICLMVIFLGTLVHKSSSQGQDRHMIRMRQLIDIVDQLKHYVNDLVPEFLPAPEDVELNCEWSAFSCFQKAQLKSANTGNNERIINVSIKKLKRKPPSTNAGARQKHRLTCPSCDSYEKKPPKEFLERFKSLLQKMIHQHLSSRTHGSEDS

SEQ ID NO: 751 - protein, 162 aa, synthetic construct
MRSSPGNMERIVICLMVIFLGTLVHKSSSQGQDRHMIRMRQLIDIVDQLKNYVNDLVPEFLPAPEDVETNCEYSAFSCFQKAQLKSANTGNNETIINVSIKKLKRKPPSTNAGLRQKHRLTCPSCDSYEKKPPKEFLERFKSLLQKMIHQHLSSRTHGSEDS

SEQ ID NO: 752 - protein, 162 aa, synthetic construct
MRSSPGNMERIVICLMVIFLGTLVHKSSSQGNDRHMIRMRQLIDIVDQLKNYVNDLVPEFLPAPEDVETNCEWSAFSCFQKAQLKSANTGNNERIINVSIKKLKRKPPSTNAGARQKHRLTCPSCDSYEKKPPKEFLERFKSLLQKMIHQHLSSRTHGSEDS

SEQ ID NO: 753 - protein, 162 aa, synthetic construct
MRSSPGNMERIVICLMVIFLGTLVHKSSSQGQDRHVIHMRQLIDIVDQLKNYVNDLVPEFLPAPEDVLTNCEWSAFSCFQKAQLKSANTGNNERIINVSIKKLKRKPPSTNAGARQKHRLTCPSCDSYEKKPPKEFLERFKSLLQKMIHQHLSSRTHGSEDS

SEQ ID NO: 754 - protein, 162 aa, synthetic construct
MRSSPGNMERIVICLMVIFLGTLVHKSSSQGQDRHMIRMEQLIDIVDQLKNYVNDLVPEFLPAPEDVETNCEWSAFSCFQKAQLKSANTGNNERIIDVSIKKLKRKYPSTIAGRRQKHRLTCPSCDSYEKKPPKEFLERFKSLLQKMIHQHLSSRTHGSEDS

SEQ ID NO: 755 - protein, 162 aa, synthetic construct
MRSSPGNMERIVICLMVIFLGTLVHKSSSQGQDRHMIRMRQLIDIVDQLKNYVNDLVTEFLPAPEDVETNCEWSAFSCFQKAQLKSANTGNNERIINVSIKKLKRKLPSTNAGNRQKHRLTCPSCDSYEKKPPKEFLERFKSLLQKMIHQHLSSRTHGSEDS

SEQ ID NO: 756 - protein, 162 aa, synthetic construct
MRSSPGNMERIVICLMVIFLGTLVHKSSSQGDDRHMIRMLQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 757 - protein, 162 aa, synthetic construct
MRSSPGNMERIVICLMVIFLGTLVHKSSSQGQDRHMIRMRQLIDIVDQLKNYVNDLVPEFLPAPEDVETNCEPSAFSCFQKAQLKSANTGNNERIINVSIKKLKRFPPPTNAGARQKHRLTCPSCDSYEKKPPKEFLERFKSLLQKMIHQHLSSRTHGSEDS

SEQ ID NO: 758 - protein, 162 aa, synthetic construct
MRSSPGNMERIVICLMVIFLGTLVHKSSSQGQDRHMIRMRQLIDIVDQLKNYVNDLVPEFLPAPEDVETNCLWSAFSCFQKAQLKSANTGNNERIINVSIKKLKRKPPSTNAGRGQKHRLTCPSCDSYEKKPPKEFLERFKSLLQKMIHQHLSSRTHGSEDS

SEQ ID NO: 759 - protein, 162 aa, synthetic construct
MRSSPGNMERIVICLMVIFLGTLVHKSSSQGQDRHMIRMRQLIDIVDELKNYVSDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 760 - protein, 162 aa, synthetic construct
MRSSPGNMERIVICLMVIFLGTLVHKSSSQGQDRHMIRMRQLIDTVDELKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 761 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHKLDCPSCDSYEKKPPKEFLERFKSLLQKMIHQHLSSRTHGSEDS

SEQ ID NO: 762 - protein, 162 aa, synthetic construct
MRSSPGNMERIVICLMVIFLGTLVHKSSSQGQDRHMIRMAQLIDIVDQLKNYVNDLEPEFLPAPEDVETNCEWSAFSCFQKAQLKSANTGNNERIINVSIKKLKRKPPSTNAGRKQKHRLTCPSCDSYEKKPPKEFLERFKSLLQKMIHQHLSSRTHGSEDS

SEQ ID NO: 763 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGARSKHRLTCPSCDSYEKKPPKEFLERFKSLLQKMIHQHLSSRTHGSEDS

SEQ ID NO: 764 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTYAGRGQKHRLTCPSCDSYEKKPPKEFLERFKSLLQKMIHQHLSSRTHGSEDS

SEQ ID NO: 765 - protein, 162 aa, synthetic construct
MRSSPGNMERIVICLMVIFLGTLVHKSSSQGADRFMIRMRQLIDIIEQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 766 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGVRQKHRSTCPSCDSYEKKPPKEFLERFKSLLQKMIHQHLSSRTHGSEDS

SEQ ID NO: 767 - protein, 162 aa, synthetic construct
MRSSPGNMERIVICLMVIFLGTLVHKSSSQGQDRHMIRMSQLLDIVDQLKNYVNDLVPEFLPAPEDVETNCEWSAFSCFQKAQLKSANTGNNERIINVSIKKLKRKPPSTNAGREQKHRLTCPSCDSYEKKPPKEFLERFKSLLQKMIHQHLSSRTHGSEDS

SEQ ID NO: 768 - protein, 162 aa, synthetic construct
MRSSPGNMERIVICLMVIFLGTLVHKSSSQGQDRSMIRMRQLIDIVDQLKNYVNDLVPEFLPAPEDVETNCEWSAFSCFQKAQLKSANTGNNERIINVSIKLLKRKPPSTNAGRRQKHRLTCPSCDSYEKKPPKEFLERFKSLLQKMIHQHLSSRTHGSEDS

SEQ ID NO: 769 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKLPITNAGRRQKHRLPCPSCDSYEKKPPKEFLERFKSLLQKMIHQHLSSRTHGSEDS

SEQ ID NO: 770 - protein, 162 aa, synthetic construct
MRSSPGNMERIVICLMVIFLGTLVHKSSSQGQDRHMIAMRQLIDIVDQLKNYVNDLEPEFLPAPEDVETNCEWSAFSCFQKAQLKSANTGNNERIINVSIKKLKRKPPSTNAGDRQKHRLTCPSCDSYEKKPPKEFLERFKSLLQKMIHQHLSSRTHGSEDS

SEQ ID NO: 771 - protein, 162 aa, synthetic construct
MRSSPGNMERIVICLMVIFLGTLVHKSSSQGQDRQEIRMRQLIDIVDQLKNYLNDLVPEFLPAPEDVETNCEWSAFSCFQKAQLKSANTGNNERIINVSIKKLKRKIPSTNAGRRQKHRLTCPSCDSYEKKPPKEFLERFKSLLQKMIHQHLSSRTHGSEDS

SEQ ID NO: 772 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFACFQKAQLKSANTGNNERIINVSIKKLKRKPPSTNAGSRQKHRLTCPSCDSYEKKPPKEFLERFKSLLQKMIHQHLSSRTHGSEDS

SEQ ID NO: 773 - protein, 162 aa, synthetic construct
MRSSPGNMERIVICLMVIFLGTLVHKSSSQGQDRHMIRMRQLIDIVDQLKNYVNDLVPEFLPAPEDVERNCEWSAFSCFQKAQLKSANTGNNEQIINVSIKKLKRKPPSTNAGRRQKHRLTCPSCDSYEKKPPKEFLERFKSLLQKMIHQHLSSRTHGSEDS

SEQ ID NO: 774 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQNAQLKSANTGNNEQIINVSIKKLKRKPPKTNAGRRQKHRLTCPSCDSYEKKPPKEFLERFKSLLQKMIHQHLSSRTHGSEDS

SEQ ID NO: 775 - protein, 162 aa, synthetic construct
MRSSPGNMERIVICLMVIFLGTLVHKSSSQGQDRHMIRMMQLIDIVDQLKNYVNDLEPEFLPAPEDVETNCEWSAFSCFQKAQLKSANTGNNERIINVSIKKLKRKPPSTNANRRQKHRLTCPSCDSYEKKPPKEFLERFKSLLQKMIHQHLSSRTHGSEDS

SEQ ID NO: 776 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANAGNNETIINVSIKKLKRKPPSTNAGRRQKHRLTCPSCDSYEKKPPKEFLERFKSLLQKMIHQHLSSRTHGSEDS

SEQ ID NO: 777 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRKQKHRLECPSCDSYEKKPPKEFLERFKSLLQKMIHQHLSSRTHGSEDS

SEQ ID NO: 778 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANPGNNERIIKVLIKALKRKPPSTNAGRRQKHRLTCPSCDSYEKKPPKEFLERFKSLLQKMIHQHLSSRTHGSEDS

SEQ ID NO: 779 - protein, 162 aa, synthetic construct
MRSSPGNMERIVICLMVIFLGTLVHKSSSQGQDRHMIRMRQLIDIVDQLKNYVNDLVPEFLPAPEDVETHCEWSAFSCFQKAQLKSANTGNNERIINVSIKKLKRKPPSTNAGIRQKHRLTCPSCDSYEKKPPKEFLERFKSLLQKMIHQHLSSRTHGSEDS

SEQ ID NO: 780 - protein, 162 aa, synthetic construct
MRSSPGNMERIVICLMVIFLGTLVHKSSSQGQFRFMIRMRQLIDIVDQLKNYVNDLVPEFLPAPEDVETNCEWAAFSCFQKAELKSANTGNNERIINVSIKKLKRKPPSTNAGRRQKHRLTCPSCDSYEKKPPKEFLERFKSLLQKMIHQHLSSRTHGSEDS

SEQ ID NO: 781 - protein, 162 aa, synthetic construct
MRSSPGNMERIVICLMVIFLGTLVHKSSSQGQDRHMIRMRQLIDIVDQLSNYVNDLVPDFLPAPEDVETNCEWSAFSCFQKAQLKSANTGNNERIINVSIKKLKRSPPSNNAGRRQKHRLTCPSCDSYEKKPPKEFLERFKSLLQKMIHQHLSSRTHGSEDS

SEQ ID NO: 782 - protein, 162 aa, synthetic construct
MRSSPGNMERIVICLMVIFLGTLVHKSSSQGVDRHMIRMRQLIDIVDQLKNYVNDLVPEQLPAPEDVETNCEWSAFSCFQKAQLKSANTGNNERIINVSIKKLKRKPPSTNENRRQKHRLTCPSCDSYEKKPPKEFLERFKSLLQKMIHQHLSSRTHGSEDS

SEQ ID NO: 783 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGRYKHRLTCPSCDSYEKKPPKEFLERFKSLLQKMIHQHLSSRTHGSEDS

SEQ ID NO: 784 - protein, 162 aa, synthetic construct
MRSSPGNMERIVICLMVIFLGTLVHKSSSQGQDRHMIRMRQLIDIVDQLKNYVNDLGPEFLPAPEDVETNCEWSAFSCFQKAQLKSANTGNNERIINVSIKKLKRKPPSTNAGGRQKHRLTCPSCDSYEKKPPKEFLERFKSLLQKMIHQHLSSRTHGSEDS

SEQ ID NO: 785 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKEPSTNAGARQKHRLTCPSCDSYEKKPPKEFLERFKSLLQKMIHQHLSSRTHGSEDS

SEQ ID NO: 786 - protein, 162 aa, synthetic construct
MRSSPGNMERIVICLMVIFLGTLVHKSSSQGLDPHMIRMRQLIDEVDQLKNYVNDLVPEFLPAPEDVETNCEWSAFSCFQKAQLKSANTGNNERIINVSIKKLKRKPPSTNAGYRQKHRLTCPSCDSYEKKPPKEFLERFKSLLQKMIHQHLSSRTHGSEDS

SEQ ID NO: 787 - protein, 162 aa, synthetic construct
MRSSPGNMERIVICLMVIFLGTLVHKSSSQGQDRHMIRMTQLIDIVDQLKNYVNDLVPEFLPAPEDVETHCEWSAFSCFQKAQLKSANTGNNERIINVSIKKLKRKPPSTNAGRFQKHRLTCPSCDSYEKKPPKEFLERFKSLLQKMIHQHLSSRTHGSEDS

SEQ ID NO: 788 - protein, 162 aa, synthetic construct
MRSSPGNMERIVICLMVIFLGTLVHKSSSQGQDRHMIRMRQLIDIVDQLKNYVNDLVPEFLPAPEDVETNCELSAFSCFQKAQLKSANTGNNERIINVSIKKLKRKLPSTNAGRRQKHRLTCPSCDSYEKKPPKEFLERFKSLLQKMIHQHLSSRTHGSEDS

SEQ ID NO: 789 - protein, 162 aa, synthetic construct
MRSSPGNMERIVICLMVIFLGTLVHKSSSQGQDRHMIRMLQLIDIVDQLKNVVNDLVPEFLPAPEDVERNCEWSAFSCFQKAQLKSANTGNNERIINVSIKKLKRKPPSTNAGQRQKHRLTCPSCDSYEKKPPKEFLERFKSLLQKMIHQHLSSRTHGSEDS

SEQ ID NO: 790 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTPATRRQKHRLECPSCDSYEKKPPKEFLERFKSLLQKMIHQHLSSRTHGSEDS

SEQ ID NO: 791 - protein, 162 aa, synthetic construct
MRSSPGNMERIVICLMVIFLGTLVHKSSSQGSDRHMIRMRQLIDIVDQLKNYVNDLVPEFLPAPEDVETNCEWSAFSCFQKAQLKSANTGNNERIINVSIKKLKRKPPSTEAGRRQKHRLTCPSCDSYEKKPPKEFLERFKSLLQKMIHQHLSSRTHGSEDS

SEQ ID NO: 792 - protein, 162 aa, synthetic construct
MRSSPGNMERIVICLMVIFLGTLVHKSSSQGQDRHVIRMRQLIDIVDQLKNMVNDLVPEFLPAPEDVETNCEWSAFSCFQKAQLKSANTGNNERIINVTIKKLKRKPPSTLAGRQQKHRLTCPSCDSYEKKPPKEFLERFKSLLQKMIHQHLSSRTHGSEDS

SEQ ID NO: 793 - protein, 162 aa, synthetic construct
MRSSPGNMERIVICLMVIFLGTLVHKSSSQGQDRHMIRMRQLIDIVDQLGNYVNDLVPEFLPAPEDVETNCEWSAFSCFQKAQLKSANLGNNERIINVSIKKLKRKPPSTNAMYRQKHRLTCPSCDSYEKKPPKEFLERFKSLLQKMIHQHLSSRTHGSEDS

SEQ ID NO: 794 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPTTNAGARQKHRLTCPSCDSYEKKPPKEFLERFKSLLQKMIHQHLSSRTHGSEDS

SEQ ID NO: 795 - protein, 162 aa, synthetic construct
MRSSPGNMERIVICLMVIFLGTLVHKSSSQGQERHMIRMRQLIDIVDQLKNYVNDLVPEFLPAPEDVETNCEWSAFSCFQKAQLKSANTGNNERIIDVSIKKLKRKPPSTNAGRRQKHRLTCPSCDSYEKKPPKEFLERFKSLLQKMIHQHLSSRTHGSEDS

SEQ ID NO: 796 - protein, 162 aa, synthetic construct
MRSSPGNMERIVICLMVIFLGTLVHKSSSQGQDRHMIRMRQLIDIVDQLKNYSNDLVPEFLPAPEDVETNCEWSAFSCFQKAQLKSANTGNNERIINVSIQKLKRKPPSTNAGRRQKHRLTCPSCDSYEKKPPKEFLERFKSLLQKMIHQHLSSRTHGSEDS

SEQ ID NO: 797 - protein, 162 aa, synthetic construct
MRSSPGNMERIVICLMVIFLGTLVHKSSSQGQDRHMIRMRQLIDIVDQLKNYVNDLVPEFLPAPEDVETNCLWSAFSCFQKAQLKSANTGNNERIINVSIKKLKRKPPSTMAGARQKHRLTCPSCDSYEKKPPKEFLERFKSLLQKMIHQHLSSRTHGSEDS

SEQ ID NO: 798 - protein, 162 aa, synthetic construct
MRSSPGNMERIVICLMVIFLGTLVHKSSSQGQDRHPIRMRQLIDIVDQLKNYVNDLVPEFLPAPEDVATNCLWSAFSCFQKAQLKSANTGNNERIINVSIKKLKRKPPSTNAGDIQKHRLTCPSCDSYEKKPPKEFLERFKSLLQKMIHQHLSSRTHGSEDS

SEQ ID NO: 799 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPATNAGARQKHRLTCPSCDSYEKKPPKEFLERFKSLLQKMIHQHLSSRTHGSEDS

SEQ ID NO: 800 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINTSIKKLKRPPPSTNAGRRQKQRLTCPSCDSYEKKPPKEFLERFKSLLQKMIHQHLSSRTHGSEDS

SEQ ID NO: 801 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIIEVSIKKLKRKPPSTNAERRKKHRLTCPSCDSYEKKPPKEFLERFKSLLQKMIHQHLSSRTHGSEDS

SEQ ID NO: 802 - protein, 162 aa, synthetic construct
MRSSPGNMERIVICLMVIFLGTLVHKSSSQGQDRHMIRMRQLIDIVDQLSNYVNDLVPEFMPAPEDVETNCEWSAFSCFQKAQLKSANTGNNERIINVSIKKLKRKPPSTNVGRRQKHRLTCPSCDSYEKKPPKEFLERFKSLLQKMIHQHLSSRTHGSEDS

SEQ ID NO: 803 - protein, 162 aa, synthetic construct
MRSSPGNMERIVICLMVIFLGTLVHKSSSQGQDRHMIRMRQLIDIVDQLKNYVNDLVVEFLPAPEDVETNCEWSAFSCFQKAQLKSANTGENERIINVSIKKLKRKLPSTNAGRRQKHRLTCPSCDSYEKKPPKEFLERFKSLLQKMIHQHLSSRTHGSEDS

SEQ ID NO: 804 - protein, 162 aa, synthetic construct
MRSSPGNMERIVICLMVIFLGTLVHKSSSQGPDRGMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 805 - protein, 162 aa, synthetic construct
MRSSPGNMERIVICLMVIFLGTLVHKSSSQGQDRHMIRMRQLIDIVDQLKNYVNDLVPEFLPAPEDVETSCEWSAFSCFQKAQLKSANTGNNERIINVSIKKLKRKPPSTGGGGRQKHRLTCPSCDSYEKKPPLEFLERFKSLLQKMIHQHLSSRTHGSEDS

SEQ ID NO: 806 - protein, 162 aa, synthetic construct
MRSSPGNMERIVICLMVIFLGTLVHKSSSQGFDRHIIRMRQLIDIVDQLKNYVNDLVPDFLPAPEDVETNCEWSAFSCFQKAQLKSANTGNNERIINVSIKKLKRKPPSTPAGRRQKHRLTCPSCDSYEKKPPKEFLERFKSLLQKMIHQHLSSRTHGSEDS

SEQ ID NO: 807 - protein, 162 aa, synthetic construct
MRSSPGNMERIVICLMVIFLGTLVHKSSSQGQDRHMMRMRQLIDIVDQLKNYVNDLVPEFLPAPEDVERNCEWSAFSCFQKAQLKSANTGNNERIINVSIKKLKRKPPSTNAGERQKHRLTCPSCDSYEKKPPKEFLERFKSLLQKMIHQHLSSRTHGSEDS

SEQ ID NO: 808 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKGQLKSANTGNNERIINVAIKKLKRKPPSTNAGRRQKHRLQCPSCDSYEKKPPKEFLERFKSLLQKMIHQHLSSRTHGSEDS

SEQ ID NO: 809 - protein, 162 aa, synthetic construct
MRSSPGNMERIVICLMVIFLGTLVHKSSSQGQDRHMIRMKQLIDSVDQLKNYVNDLVPEFLPAPEDVETNCEWSAFSCFQGAQLKSANTGNNERIINVSIKKLKRKPPSTNAGRTQKHRLTCPSCDSYEKKPPKEFLERFKSLLQKMIHQHLSSRTHGSEDS

SEQ ID NO: 810 - protein, 162 aa, synthetic construct
MRSSPGNMERIVICLMVIFLGTLVHKSSSQGQDRHMIRMRQLIDIVDQLKNYVNDLVPEFLPAPEDVEKNCEWSAFSCFQKAQLKSANTGNNERIINVLIKKLKRKPPSTMAGRRQKHRLTCPSCDSYEKKPPKEFLERFKSLLQKMIHQHLSSRTHGSEDS

SEQ ID NO: 811 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFLCFQKAQLKSANTGNNERIINVSIKKLKRKPPSTNAGARQKHRYTCPSCDSYEKKPPKEFLERFKSLLQKMIHQHLSSRTHGSEDS

SEQ ID NO: 812 - protein, 162 aa, synthetic construct
MRSSPGNMERIVICLMVIFLGTLVHKSSSQGQDRHMIRMRQLIDIVDQLKNYVNDLDPEFLPAPEDVETNCEWSAFSCFQKAQLKSANGGNNERIINVSIKKLKRKPPSTNAGRRQKHRLTCPSCDSYEKKPPKEFLERFKSLLQKMIHQHLSSRTHGSEDS

SEQ ID NO: 813 - protein, 162 aa, synthetic construct
MRSSPGNMERIVICLMVIFLGTLVHKSSSQGQDRHMIRMRQLIDIVDQLSNYVNDLVPDFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 814 - protein, 162 aa, synthetic construct
MRSSPGNMERIVICLMVIFLGTLVHKSSSQGQDRLMIRMRQLSDIVDQLKNYVNDLVPEFLPAPEDVETNCEWSAFSCFQKAQLKSANTGNNERIINVSIKKLKRKPISTNAGERQKHRLTCPSCDSYEKKPPKEFLERFKSLLQKMIHQHLSSRTHGSEDS

SEQ ID NO: 815 - protein, 162 aa, synthetic construct
MRSSPGNMERIVICLMVIFLGTLVHKSSSQGQDRHMIRMRQLIDIVDQLKHYVNDLVPEFLPAPEDVETNCEWEAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 816 - protein, 162 aa, synthetic construct
MRSSPGNMERIVICLMVIFLGTLVHKSSSQGQDRQMIRMRQLIDIVDQLKNMVNDLVPEFLPAPEDVETECEWSAFSCFQKAQLKSANTGGNERIINVSIKKLKRKPPSTNAGRRQKHRLTCPSCDSYEKKPPKEFLERFKSLLQKMIHQHLSSRTHGSEDS

SEQ ID NO: 817 - protein, 162 aa, synthetic construct
MRSSPGNMERIVICLMVIFLGTLVHKSSSQGVVRHMIRMRQLIDIVDQLKNYVNDLVPEFLPAPEDVETNCEWSAFSCFQKAQLKSANTGNNERIINVSIKELKRKPPSTNAGRRQKHRLTCPSCDSYEKKPPKEFLERFKSLLQKMIHQHLSSRTHGSEDS

SEQ ID NO: 818 - protein, 162 aa, synthetic construct
MRSSPGNMERIVICLMVIFLGTLVHKSSSQGQDRHMIRMRQLIDTVDQLKNYVNDLVPEQLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 819 - protein, 162 aa, synthetic construct
MRSSPGNMERIVICLMVIFLGTLVHKSSSQGQDRHMIRMKQLIDIVDQLKNYVNDLMPEFLPAPEDVETNCEWSAFSCFQRAQLKSANTGNNERIINISIKKLKRKIPSTNAGRRQKHRLTCPSCDSYEKKPPKEFLERFKSLLQKMIHQHLSSRTHGSEDS

SEQ ID NO: 820 - protein, 162 aa, synthetic construct
MRSSPGNMERIVICLMVIFLGTLVHKSSSQGQDRSMIRMRQLIDIVDQLKNYVNDLVPEFLPAPEDVETNCEWSAFSCFQKAQLKSANTGNNERIINGSIKKLKRKPPSTNAGRRQKHRLTCPSCDSYEKKPPKEFLERFKSLLQKMIHQHLSSRTHGSEDS

SEQ ID NO: 821 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVTIKKLKRKPPSTNAGRRQKQRLTCPSCDSYEKKPPKEFLERFKSLLQKMIHQHLSSRTHGSEDS

SEQ ID NO: 822 - protein, 162 aa, synthetic construct
MRSSPGNMERIVICLMVIFLGTLVHKSSSQGQDRHMIRMRQLIDIVDQLKNYSNDLVPEFLPAPEDVETNCEWSAFSCFQKAQLKSANTGNNERIINVAIKKLKRKPPSTNAGRRQKHRLTCPSCDSYEKKPPKEFLERFKSLLQKMIHQHLSSRTHGSEDS

SEQ ID NO: 823 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGARQKHRKTCPSCDSYEKKPPKEFLERFKSLLQKMIHQHLSSRTHGSEDS

SEQ ID NO: 824 - protein, 162 aa, synthetic construct
MRSSPGNMERIVICLMVIFLGTLVHKSSSQGQARHMIRMRQLIDIVDQLKNYVNELVPEFLPAPEDVETNCEWSAFSCFQKAQLKSANTGNNERIINVSIKQLKRKPPSTNVGRRQKHRLTCPSCDSYEKKPPKEFLERFKSLLQKMIHQHLSSRTHGSEDS

SEQ ID NO: 825 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTSAGYRQKHRLTCPSCDSYEKKPPKEFLERFKSLLQKMIHQHLSSRTHGSEDS

SEQ ID NO: 826 - protein, 162 aa, synthetic construct
MRSSPGNMERIVICLMVIFLGTLVHKSSSQGQDRSMIRMRQLIDIVDQLKNYVNDLVPEALPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 827 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRREKHRQTCPSCDSYEKKPPKEFLERFKSLLQKMIHQHLSSRTHGSEDS

SEQ ID NO: 828 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANNGNNERIINVSIKKLKRKLPSTNAVRRQKHRLTCPSCDSYEKKPPKEFLERFKSLLQKMIHQHLSSRTHGSEDS

SEQ ID NO: 829 - protein, 162 aa, synthetic construct
MRSSPGNMERIVICLMVIFLGTLVHKSSSQGQERHMIRMRQLIDIVDELKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 830 - protein, 162 aa, synthetic construct
MRSSPGNMERIVICLMVIFLGTLVHKSSSQGQDRHMIRMRQLQDIVDQLSNYVEDLVPENLPAPEDVETNCEWSAFSCFQKAQLKSANTGNNERIINVSIKKLKRIPPSTNAGRRQKHRLTCPSCDSYEKKPPKEFLERFKSLLQKMIHQHLSSRTHGSEDS

SEQ ID NO: 831 - protein, 162 aa, synthetic construct
MRSSPGNMERIVICLMVIFLGTLVHKSSSQGQDRHMERMRQLIDIVDQLKNYVNDLVPEFLPAPEDVETNCEWSAFSCFQKAQLKSANTGNNERIINVSIKKLKRKPPSTNAGERQKHRLTCPSCDSYEKKPPKEFLERFKSLLQKMIHQHLSSRTHGSEDS

SEQ ID NO: 832 - protein, 162 aa, synthetic construct
MRSSPGNMERIVICLMVIFLGTLVHKSSSQGQDTHMIRMRQLIDIVDQLKNYVNDLVPEFLPAPEDVETNCEWSAFSCFQKAQLKSANTGNNERIINVSIKKLKRKPPSTDAGRRQKHRLTCPSCDSYEKKPPKEFLERFKSLLQKMIHQHLSSRTHGSEDS

SEQ ID NO: 833 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGGNERIINVSIKKLKRKPPSTNAGARTKHRLPCPSCDSYEKKPPKEFLERFKSLLQKMIHQHLSSRTHGSEDS

SEQ ID NO: 834 - protein, 162 aa, synthetic construct
MRSSPGNMERIVICLMVIFLGTLVHKSSSQGSDRHMIRMRQLIDIVDQLKNYVNDLVPEFLPAPEDVETNCEQSAFSCFQKAQLKSANTGNNERIINVSIKKLGRKLPSTRAGRRQKHRLTCPSCDSYEKKPPKEFLERFKSLLQKMIHQHLSSRTHGSEDS

SEQ ID NO: 835 - protein, 162 aa, synthetic construct
MRSSPGNMERIVICLMVIFLGTLVHKSSSQGIDRHNIRMRQLIDIVDQLKNYVNDLVPEFLPAPEDVETNCEWSAFSCFQKAQLKSANTGNNENIINVSIKKLKRKPPSTNAGRRQKHRLTCPSCDSYEKKPPKEFLERFKSLLQKMIHQHLSSRTHGSEDS

SEQ ID NO: 836 - protein, 162 aa, synthetic construct
MRSSPGNMERIVICLMVIFLGTLVHKSSSQGQDRFPIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 837 - protein, 162 aa, synthetic construct
MRSSPGNMERIVICLMVIFLGTLVHKSSSQGQDRHMIRMRQLIDIVDQLKHYVNDLVPEFLPAPEDVETNCEWSAFSCFQKAQLKSANTGNNERIINVSIKKLKRKPPSTNAGSRQKHRLTCPSCDSYEKKPPKEFLERFKSLLQKMIHQHLSSRTHGSEDS

SEQ ID NO: 838 - protein, 162 aa, synthetic construct
MRSSPGNMERIVICLMVIFLGTLVHKSSSQGADRHMIRMRQLIDIVDQLKNYVNDLVPEFLPAPEDVETNCEWSAFSCFQKAQLKSANTGNNERIINVSIKKLKRKPPSTDAQRRQKHRLTCPSCDSYEKKPPKEFLERFKSLLQKMIHQHLSSRTHGSEDS

SEQ ID NO: 839 - protein, 162 aa, synthetic construct
MRSSPGNMERIVICLMVIFLGTLVHKSSSQGADRHMIRMHQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 840 - protein, 162 aa, synthetic construct
MRSSPGNMERIVICLMVIFLGTLVHKSSSQGQDRHMIRMRQLIDIVDLLKTYVNDLVPEFLPAPEDVETNCEWSAFSCFQKAQLKSANTGNNERIINNSIKKLKRKPPSTNAGRRQKHRLTCPSCDSYEKKPPKEFLERFKSLLQKMIHQHLSSRTHGSEDS

SEQ ID NO: 841 - protein, 162 aa, synthetic construct
MRSSPGNMERIVICLMVIFLGTLVHKSSSQGQDRHMIRMRQLIDIVDQLSNYVNDLVPEFLPAPEDVETNCEWSAFSCFQKAQLKSANTGNNERIINISIKKLKRKPPSTNAGRRQKHRLTCPSCDSYEKKPPKEFLERFKSLLQKMIHQHLSSRTHGSEDS

SEQ ID NO: 842 - protein, 162 aa, synthetic construct
MRSSPGNMERIVICLMVIFLGTLVHKSSSQGQDRHMIRMRQLIDIVDQLKTYVNDLVPEFLPAPEDVETNCEWSAFSCFQKAQLKSANTGNNERIINVSIKKLKRKPPSTSAGRRQKHRLTCPSCDSYEKKPPKEFLERFKSLLQKMIHQHLSSRTHGSEDS

SEQ ID NO: 843 - protein, 162 aa, synthetic construct
MRSSPGNMERIVICLMVIFLGTLVHKSSSQGQERHMIRMRQLIDIVDQLKNYVNDLVPEFLPAPEDVETNCEWSAFSCFQKAQLKSANTGNNERIINVSIKKLSRKPPSTNAGRRQKHRLTCPSCDSYEKKPPKEFLERFKSLLQKMIHQHLSSRTHGSEDS

SEQ ID NO: 844 - protein, 162 aa, synthetic construct
MRSSPGNMERIVICLMVIFLGTLVHKSSSQGQDRHMIHMRQLIDTVDQLKNYVNDLVPEFLAAPEDVETNCEWSAFSCFQKAQLKSANTGNNERIINVSIKKLKRKPPSTYAGYRQKHRLTCPSCDSYEKKPPKEFLERFKSLLQKMIHQHLSSRTHGSEDS

SEQ ID NO: 845 - protein, 162 aa, synthetic construct
MRSSPGNMERIVICLMVIFLGTLVHKSSSQGEDRTMMRMRQLIDIVDQLKNYVNDLVPEFLPAPEDVETTCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 846 - protein, 162 aa, synthetic construct
MRSSPGNMERIVICLMVIFLGTLVHKSSSQGQDREMIRMRQLIDIVDQLKTYVNDLVPLFLPAPEDVETNCEWSAFSCFQKAQLKSANTGNNERIINVSIKKLKRQPPSTNAARRQKHRLTCPSCDSYEKKPPKEFLERFKSLLQKMIHQHLSSRTHGSEDS

SEQ ID NO: 847 - protein, 162 aa, synthetic construct
MRSSPGNMERIVICLMVIFLGTLVHKSSSQGQDRHMIRMRQLIDIVDQLKNYVNDLVPEFLHAPEDVETNCEWSAFSCFQKAQLKSANTGNNERIINVLIKKLKRKPPSTNAGRRQKHRLTCPSCDSYEKKPPKEFLERFKSLLQKMIHQHLSSRTHGSEDS

SEQ ID NO: 848 - protein, 162 aa, synthetic construct
MRSSPGNMERIVICLMVIFLGTLVHKSSSQGQDRHMIRMRQLIDIVDQLKNYVNDLVPELLPAPEDVETNCEWSAFSCFQKAQLKSANTGNNERIINVSIKKLKRKPPSTSAGRRQKHRLTCPSCDSYEKKPPKEFLERFKSLLQKMIHQHLSSRTHGSEDS

SEQ ID NO: 849 - protein, 162 aa, synthetic construct
MRSSPGNMERIVICLMVIFLGTLVHKSSSQGQDRYMIRMRQLSDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 850 - protein, 162 aa, synthetic construct
MRSSPGNMERIVICLMVIFLGTLVHKSSSQGQDRHMIRMRQLIDIVDQLKNYVNDLVPEFLPAPEDVETHCEWSAFSCFQKAQLKSANTGNNERIINVSIKKLKRKPPSTNAGRQQKHRATCPSCDSYEKKPPKEFLERFKSLLQKMIHQHLSSRTHGSEDS

SEQ ID NO: 851 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNSERIINVSIKKLKRLPPSTTAGRRQKQRLTCPSCDSYEKKPPKEFLERFKSLLQKMLHQHLSSRTHGSEDS

SEQ ID NO: 852 - protein, 162 aa, synthetic construct
MRSSPGNMERIVICLMVIFLGTLVHKSSSQGQDRHMIRMRQLIDIVDQLKNYVNDLVPEFLPAPEDVEDNCEWSAFSCFQKAQLKSANTGNNERIINVSIKKLKRKPPSTNAGRKQKHRLTCPSCDSYEKKPPKEFLERFKSLLQKMIHQHLSSRTHGSEDS

SEQ ID NO: 853 - protein, 162 aa, synthetic construct
MRSSPGNMERIVICLMVIFLGTLVHKSSSQGQDRSMIRMRQLIDIVDQLKNYVNDLKPEFLPAPNDVETNCEWSAFSCFQKAQLKSANTGENERIINVSIKKLKRKPPSTNAGRRQKHRLTCPSCDSYEKKPPKEFLERFKSLLQKMIHQHLSSRTHGSEDS

SEQ ID NO: 854 - protein, 162 aa, synthetic construct
MRSSPGNMERIVICLMVIFLGTLVHKSSSQGQDRHMIRMRQLIDIVDQLKHYVNDLVPEFLPAPQDVETNCEWSAFSCFQKAQLKSANTGNNERIINVSIKKLKRKMPSTNAGRRQKHRLTCPSCDSYEKKPPKEFLERFKSLLQKMIHQHLSSRTHGSEDS

SEQ ID NO: 855 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGKNERIINVSIKKLKRKPPSTNAGRRQKERDTCPSCDSYEKKPPKEFLKRFKSLLQKMIHQHLSSRTHGSEDS

SEQ ID NO: 856 - protein, 162 aa, synthetic construct
MRSSPGNMERIVICLMVIFLGTLVHKSSSQGQDRHMIRMRQLIDIVDQLKNYVNDLVPEFLPAPEDVETNCLWSAFSCFQKAQLKSANSGNNERIINVSIKKLKRKIPSTNAGRRQKHRLTCPSCDSYEKKPPKEFLERFKSLLQKMIHQHLSSRTHGSEDS

SEQ ID NO: 857 - protein, 162 aa, synthetic construct
MRSSPGNMERIVICLMVIFLGTLVHKSSSQGQPRHIIRMRQLIDIVDQLKNYVNDLVPEFLPAPEDVETNCEWSAFSCFQKAQLKAANTGNNERIINVSIKKLKRKPPSTNAGVRQKHRLTCPSCDSYEKKPPKEFLERFKSLLQKMIHQHLSSRTHGSEDS

SEQ ID NO: 858 - protein, 162 aa, synthetic construct
MRSSPGNMERIVICLMVIFLGTLVHKSSSQGQDRHMIRMRQLIDIVDQLGNYVNDLSPEDLPAPEDVETNCEWSAFSCFQKAQLKSANTGNNERIINVSIKKLKRKPPSTNTGRRQKHRLTCPSCDSYEKKPPKEFLERFKSLLQKMIHQHLSSRTHGSEDS

SEQ ID NO: 859 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKERLPCPSCDSYEKKPPKEFLERFKSLLQKMIHQHLSSRTHGSEDS

SEQ ID NO: 860 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAELKSANTGNNERIINVSIKKLKRKPPSTNAGRRQKHRLKCPSCDSYEKKPPKEFLERFKSLLQKMIHQHLSSRTHGSEDS

SEQ ID NO: 861 - protein, 162 aa, synthetic construct
MRSSPGNMERIVICLMVIFLGTLVHKSSSQGQWRHMIRMRQLVDIVDQLKNYVNDLVPEFLPAPEDVETNCEWSALSCFQKAQLKSANTGNNERIINSSIKKLKRKPPSTNAGTRQKHRLTCPSCDSYEKKPPKEFLERFKSLLQKMIHQHLSSRTHGSEDS

SEQ ID NO: 862 - protein, 162 aa, synthetic construct
MRSSPGNMERIVICLMVIFLGTLVHKSSSQGQDRHMIRMRQLISIVDQLKNYVNDLVPEFLPAPEDVETNCEWSAFSCFQKAQLKSANTGNNERIINVSIKKLKRKIPSTNAGRTQKHRLTCPSCDSYEKKPPKEFLERFKSLLQKMIHQHLSSRTHGSEDS

SEQ ID NO: 863 - protein, 162 aa, synthetic construct
MRSSPGNMERIVICLMVIFLGTLVHKSSSQGQDRSMIRMRQLIDIVDQLKNYVNDLVVEFLPAPEDVETNCEWSAFSCFQKAQLKSANTGNNERIINVSIKKLKRVPPSTNAGRRQKHRLTCPSCDSYEKKPPKEFLERFKSLLQKMIHQHLSSRTHGSEDS

SEQ ID NO: 864 - protein, 162 aa, synthetic construct
MRSSPGNMERIVICLMVIFLGTLVHKSSSQGQDRMMIRMRQLIDIVDQLKNYVNDLVPEFLPAPEDVETNCEWSAFSCFQKAQLKSANTGNNERIINVSIKKLKRKPPSTNAGARQKHRLTCPSCDSYEKKPPKEFLERFKSLLQKMIHQHLSSRTHGSEDS

SEQ ID NO: 865 - protein, 162 aa, synthetic construct
MRSSPGNMERIVICLMVIFLGTLVHKSSSQGQDRHMIRMRQLIDIVDQLSNYVNDLVPEFLPAPEDVETNCEWSAFYCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 866 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINISIKKLKRKPPSTNAGRRQKHKLTCPSCDSYEKKPPKEFLERFKSLLQKMIHQHLSSRTHGSEDS

SEQ ID NO: 867 - protein, 162 aa, synthetic construct
MRSSPGNMERIVICLMVIFLGTLVHKSSSQGQDRHMIRMRQLIDIVDQLKNYVNDLVPEFLPAPEDVERNCEWSAFSCFQKAQLKSANTGNNETIINVSIKKLKRKPPSTNAGRRQKHRLTCPSCDSYEKKPPKEFLERFKSLLQKMIHQHLSSRTHGSEDS

SEQ ID NO: 868 - protein, 162 aa, synthetic construct
MRSSPGNMERIVICLMVIFLGTLVHKSSSQGQERHMIRMRQLIDIVDQLKNYVNDLVPEFLPAPEDVETNCEWSAFSCFQKAQLKSANTGNNERIINVSIKKLKRKPPSTNAMRAQKHRLTCPSCDSYEKKPPKEFLERFKSLLQKMIHQHLSSRTHGSEDS

SEQ ID NO: 869 - protein, 162 aa, synthetic construct
MRSSPGNMERIVICLMVIFLGTLVHKSSSQGQDRHTIRMRQLIDIVDQLKNYVNDLVPEFLPAPEDVETNCEWSAFSCFQKAQLKSANTGNNERIINVSIKKLKRKIPSTNANRRQKHRLTCPSCDSYEKKPPKEFLERFKSLLQKMIHQHLSSRTHGSEDS

SEQ ID NO: 870 - protein, 162 aa, synthetic construct
MRSSPGNMERIVICLMVIFLGTLVHKSSSQGQDRHMIRMRQLIDIVDQLGNYVNDLVPEFLPAPEDVETNCEWSAFSCFQKAQLKSANTGNNERIINISIKKLKRKPPSTNAGRRQKHRLTCPSCDSYEKKPPKEFLERFKSLLQKMIHQHLSSRTHGSEDS

SEQ ID NO: 871 - protein, 162 aa, synthetic construct
MRSSPGNMERIVICLMVIFLGTLVHKSSSQGQDRHMIRMRQLIDIVDQLKNYVNDLVPEFLPAPEDVETGCELSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 872 - protein, 162 aa, synthetic construct
MRSSPGNMERIVICLMVIFLGTLVHKSSSQGQDRHMIRMRQLIDIVDQLKNYVKDLVPEFLPAPEDVETNCEWSAFVCFQKAQLKSANTGNNERIINQSIKKLKRKPPSTNAGARQKHRLTCPSCDSYEKKPPKEFLERFKSLLQKMIHQHLSSRTHGSEDS

SEQ ID NO: 873 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQSAQLKSANTGNNERIINVSIKKLKRKPPSTNAGRRQKHRLTCPSCDSYEKKPPKEFLERFKSLLQKMIHQHLSSRTHGSEDS

SEQ ID NO: 874 - protein, 162 aa, synthetic construct
MRSSPGNMERIVICLMVIFLGTLVHKSSSQGQDRHMIRMRQLIDIVDQLKHYVNDLVPEFYPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 875 - protein, 162 aa, synthetic construct
MRSSPGNMERIVICLMVIFLGTLVHKSSSQGQDRHMIRMLQLISIVDQLKNYVNDLVPEFLPAPEDVETNCEWSAFSCFQKAQLKSANTGNNERIINVSIKELKRKPPSTNAGRRQKHRLTCPSCDSYEKKPPKEFLERFKSLLQKMIHQHLSSRTHGSEDS

SEQ ID NO: 876 - protein, 162 aa, synthetic construct
MRSSPGNMERIVICLMVIFLGTLVHKSSSQGQDRHMIRMRQLIDIVDQLKNHVNDLVPEFLPAPEDVETNCEWSAFSCFQKAQLKSANTGNNERIINVSIKKLERKPPSTNAGRRQKHRLTCPSCDSYEKKPPKEFLERFKSLLQKMIHQHLSSRTHGSEDS

SEQ ID NO: 877 - protein, 162 aa, synthetic construct
MRSSPGNMERIVICLMVIFLGTLVHKSSSQGQDRTMIRMRQLIDIVDQLKNYVNDLVPEFLPAPEDVEGNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 878 - protein, 162 aa, synthetic construct
MRSSPGNMERIVICLMVIFLGTLVHKSSSQGQDRFTIRMRQLIDIVDQLKNYVNDLVPEFLPAPEDVETNCEWSAFSCFQKAQLKSANTGNNERIINQSIKKLKRKPPSTNRGRRQKHRLTCPSCDSYEKKPPKEFLERFKSLLQKMIHQHLSSRTHGSEDS

SEQ ID NO: 879 - protein, 162 aa, synthetic construct
MRSSPGNMERIVICLMVIFLGTLVHKSSSQGQDGTMIRMRQLIDIVDQLKNYVNDLVPEFLPAPEDVETNCEWSAFSCFQKAQLKSANTGNNERIINVSIKKLKRKPPSTNAGRHQKHRLTCPSCDSYEKKPPKEFLERFKSLLQKMIHQHLSSRTHGSEDS

SEQ ID NO: 880 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFACFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 881 - protein, 162 aa, synthetic construct
MRSSPGNMERIVICLMVIFLGTLVHKSSSQGQDRHAIRMRQLIDIVDQLKNYVNDLAPTLLPAPEDVETNCEWSAFSCFQKAQLKSANTGNNERIINLSIKKLKRKPPSTNAGRRQKHRLTCPSCDSYEKKPPKEFLERFKSLLQKMIHQHLSSRTHGSEDS

SEQ ID NO: 882 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIITVSIKKLKRKPPSTNAGVRQKHRLTCPSCDSYEKKPPKEFLERFKSLLQKMIHQHLSSRTHGSEDS

SEQ ID NO: 883 - protein, 162 aa, synthetic construct
MRSSPGNMERIVICLMVIFLGTLVHKSSSQGQDRSTIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 884 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSTNAGGDQKHRLTCPSCDSYEKKPPKEFLERFKSLLQKMIHQHLSSRTHGSEDS

SEQ ID NO: 885 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSDNAGRDQKHRLTCPSCDSYEKKPPKEFLERFKSLLQKMIHQHLSSRTHGSEDS

SEQ ID NO: 886 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINESIKKLKRKPPSTNAGRDQKHRLTCPSCDSYEKKPPKEFLERFKSLLQKMIHQHLSSRTHGSEDS

SEQ ID NO: 887 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKVPSTNAGRGQKHRLTCPSCDSYEKKPPKEFLERFKSLLQKMIHQHLSSRTHGSEDS

SEQ ID NO: 888 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINESIKKLKRKPPSTNAGRGQKHRLTCPSCDSYEKKPPKEFLERFKSLLQKMIHQHLSSRTHGSEDS

SEQ ID NO: 889 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSDNAGGRQKHRLTCPSCDSYEKKPPKEFLERFKSLLQKMIHQHLSSRTHGSEDS

SEQ ID NO: 890 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKRKPPSTNAGRGQKHRLTCPSCDSYEKKPPKEFLERFKSLLQKMIHQHLSSRTHGSEDS

SEQ ID NO: 891 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGRGQKDRLTCPSCDSYEKKPPKEFLERFKSLLQKMIHQHLSSRTHGSEDS

SEQ ID NO: 892 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGRDQKHRLECPSCDSYEKKPPKEFLERFKSLLQKMIHQHLSSRTHGSEDS

SEQ ID NO: 893 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKVPSTNAGRDQKHRLTCPSCDSYEKKPPKEFLERFKSLLQKMIHQHLSSRTHGSEDS

SEQ ID NO: 894 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 895 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKVPSTNAGGRQKHRLTCPSCDSYEKKPPKEFLERFKSLLQKMIHQHLSSRTHGSEDS

SEQ ID NO: 896 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSTNAGGDQKHRLTCPSCDSYEKKPPKEFLERFKSLLQKMIHQHLSSRTHGSEDS

SEQ ID NO: 897 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKRKPPSTNAGQRQKHRLTCPSCDSYEKKPPKEFLERFKSLLQKMIHQHLSSRTHGSEDS

SEQ ID NO: 898 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGGDQKHTLTCPSCDSYEKKPPKEFLERFKSLLQKMIHQHLSSRTHGSEDS

SEQ ID NO: 899 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGRGQKDRLTCPSCDSYEKKPPKEFLERFKSLLQKMIHQHLSSRTHGSEDS

SEQ ID NO: 900 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 901 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGQGQKHRLTCPSCDSYEKKPPKEFLERFKSLLQKMIHQHLSSRTHGSEDS

SEQ ID NO: 902 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKVPSDNAGRRQKHRLTCPSCDSYEKKPPKEFLERFKSLLQKMIHQHLSSRTHGSEDS

SEQ ID NO: 903 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSDNAGRDQKHRLTCPSCDSYEKKPPKEFLERFKSLLQKMIHQHLSSRTHGSEDS

SEQ ID NO: 904 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGRRQKDRLECPSCDSYEKKPPKEFLERFKSLLQKMIHQHLSSRTHGSEDS

SEQ ID NO: 905 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGQDQKHRLTCPSCDSYEKKPPKEFLERFKSLLQKMIHQHLSSRTHGSEDS

SEQ ID NO: 906 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSDNAGGRQKHRLTCPSCDSYEKKPPKEFLERFKSLLQKMIHQHLSSRTHGSEDS

SEQ ID NO: 907 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKVPSTNAGRRQKDRLTCPSCDSYEKKPPKEFLERFKSLLQKMIHQHLSSRTHGSEDS

SEQ ID NO: 908 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNPGGRQKHRLTCPSCDSYEKKPPKEFLERFKSLLQKMIHQHLSSRTHGSEDS

SEQ ID NO: 909 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGRDQKHTLTCPSCDSYEKKPPKEFLERFKSLLQKMIHQHLSSRTHGSEDS

SEQ ID NO: 910 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGGDQKHRLTCPSCDSYEKKPPKEFLERFKSLLQKMIHQHLSSRTHGSEDS

SEQ ID NO: 911 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGQDQKDRLTCPSCDSYEKKPPKEFLERFKSLLQKMIHQHLSSRTHGSEDS

SEQ ID NO: 912 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGQDQKHRLTCPSCDSYEKKPPKEFLERFKSLLQKMIHQHLSSRTHGSEDS

SEQ ID NO: 913 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGGDQKDRLTCPSCDSYEKKPPKEFLERFKSLLQKMIHQHLSSRTHGSEDS

SEQ ID NO: 914 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 915 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSDNAGRDQKHRLTCPSCDSYEKKPPKEFLERFKSLLQKMIHQHLSSRTHGSEDS

SEQ ID NO: 916 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKVPSTNAGQRQKHRLTCPSCDSYEKKPPKEFLERFKSLLQKMIHQHLSSRTHGSEDS

SEQ ID NO: 917 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSTNAGQDQKHRLTCPSCDSYEKKPPKEFLERFKSLLQKMIHQHLSSRTHGSEDS

SEQ ID NO: 918 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINESIKKLKRKPPSTNAGRDQKHRLTCPSCDSYEKKPPKEFLERFKSLLQKMIHQHLSSRTHGSEDS

SEQ ID NO: 919 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKRKPPSTNPGRRQKHRLTCPSCDSYEKKPPKEFLERFKSLLQKMIHQHLSSRTHGSEDS

SEQ ID NO: 920 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGQDQKHRLTCPSCDSYEKKPPKEFLERFKSLLQKMIHQHLSSRTHGSEDS

SEQ ID NO: 921 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 922 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGQDQKHRLTCPSCDSYEKKPPKEFLERFKSLLQKMIHQHLSSRTHGSEDS

SEQ ID NO: 923 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGRDQKHRLTCPSCDSYEKKPPKEFLERFKSLLQKMIHQHLSSRTHGSEDS

SEQ ID NO: 924 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGGDQKHRLTCPSCDSYEKKPPKEFLERFKSLLQKMIHQHLSSRTHGSEDS

SEQ ID NO: 925 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 926 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINESIKKLKRKPPSTNAGRDQKHRLTCPSCDSYEKKPPKEFLERFKSLLQKMIHQHLSSRTHGSEDS

SEQ ID NO: 927 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGRDQKDRLTCPSCDSYEKKPPKEFLERFKSLLQKMIHQHLSSRTHGSEDS

SEQ ID NO: 928 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGQGQKHRLTCPSCDSYEKKPPKEFLERFKSLLQKMIHQHLSSRTHGSEDS

SEQ ID NO: 929 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRDQKDRLECPSCDSYEKKPPKEFLERFKSLLQKMIHQHLSSRTHGSEDS

SEQ ID NO: 930 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 931 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKRKPPSTNAGRDQKHRLTCPSCDSYEKKPPKEFLERFKSLLQKMIHQHLSSRTHGSEDS

SEQ ID NO: 932 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGQDQKHRLTCPSCDSYEKKPPKEFLERFKSLLQKMIHQHLSSRTHGSEDS

SEQ ID NO: 933 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 934 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSTNAGQDQKHRLTCPSCDSYEKKPPKEFLERFKSLLQKMIHQHLSSRTHGSEDS

SEQ ID NO: 935 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINESIKKLKRKPPSTNAGQRQKHRLTCPSCDSYEKKPPKEFLERFKSLLQKMIHQHLSSRTHGSEDS

SEQ ID NO: 936 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGQGQKDRLTCPSCDSYEKKPPKEFLERFKSLLQKMIHQHLSSRTHGSEDS

SEQ ID NO: 937 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGGRQKDRLTCPSCDSYEKKPPKEFLERFKSLLQKMIHQHLSSRTHGSEDS

SEQ ID NO: 938 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSDNPGRRQKHRLTCPSCDSYEKKPPKEFLERFKSLLQKMIHQHLSSRTHGSEDS

SEQ ID NO: 939 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKVPSTNPGRRQKHRLTCPSCDSYEKKPPKEFLERFKSLLQKMIHQHLSSRTHGSEDS

SEQ ID NO: 940 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGRRQKDTLTCPSCDSYEKKPPKEFLERFKSLLQKMIHQHLSSRTHGSEDS

SEQ ID NO: 941 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGGDQKHRLTCPSCDSYEKKPPKEFLERFKSLLQKMIHQHLSSRTHGSEDS

SEQ ID NO: 942 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRDQKDTLTCPSCDSYEKKPPKEFLERFKSLLQKMIHQHLSSRTHGSEDS

SEQ ID NO: 943 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGGDQKHRLTCPSCDSYEKKPPKEFLERFKSLLQKMIHQHLSSRTHGSEDS

SEQ ID NO: 944 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGRDQKHRLTCPSCDSYEKKPPKEFLERFKSLLQKMIHQHLSSRTHGSEDS

SEQ ID NO: 945 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKRKPPSTNAGGRQKHRLTCPSCDSYEKKPPKEFLERFKSLLQKMIHQHLSSRTHGSEDS

SEQ ID NO: 946 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGRDQKDRLTCPSCDSYEKKPPKEFLERFKSLLQKMIHQHLSSRTHGSEDS

SEQ ID NO: 947 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKVPSTNAGRDQKHRLTCPSCDSYEKKPPKEFLERFKSLLQKMIHQHLSSRTHGSEDS

SEQ ID NO: 948 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSDNAGQRQKHRLTCPSCDSYEKKPPKEFLERFKSLLQKMIHQHLSSRTHGSEDS

SEQ ID NO: 949 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSDNAGRDQKHRLTCPSCDSYEKKPPKEFLERFKSLLQKMIHQHLSSRTHGSEDS

SEQ ID NO: 950 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 951 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGRDQKHTLTCPSCDSYEKKPPKEFLERFKSLLQKMIHQHLSSRTHGSEDS

SEQ ID NO: 952 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSDNAGRGQKHRLTCPSCDSYEKKPPKEFLERFKSLLQKMIHQHLSSRTHGSEDS

SEQ ID NO: 953 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSDNAGRRQKDRLTCPSCDSYEKKPPKEFLERFKSLLQKMIHQHLSSRTHGSEDS

SEQ ID NO: 954 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSDNAGRRQKHRLECPSCDSYEKKPPKEFLERFKSLLQKMIHQHLSSRTHGSEDS

SEQ ID NO: 955 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINESIKKLKRKPPSTNAGRGQKHRLTCPSCDSYEKKPPKEFLERFKSLLQKMIHQHLSSRTHGSEDS

SEQ ID NO: 956 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGQDQKHRLTCPSCDSYEKKPPKEFLERFKSLLQKMIHQHLSSRTHGSEDS

SEQ ID NO: 957 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGQRQKHTLTCPSCDSYEKKPPKEFLERFKSLLQKMIHQHLSSRTHGSEDS

SEQ ID NO: 958 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSTNPGRDQKHRLTCPSCDSYEKKPPKEFLERFKSLLQKMIHQHLSSRTHGSEDS

SEQ ID NO: 959 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSDNAGRDQKHRLTCPSCDSYEKKPPKEFLERFKSLLQKMIHQHLSSRTHGSEDS

SEQ ID NO: 960 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGRDQKDRLTCPSCDSYEKKPPKEFLERFKSLLQKMIHQHLSSRTHGSEDS

SEQ ID NO: 961 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSDNAGGRQKHRLTCPSCDSYEKKPPKEFLERFKSLLQKMIHQHLSSRTHGSEDS

SEQ ID NO: 962 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGQGQKHRLECPSCDSYEKKPPKEFLERFKSLLQKMIHQHLSSRTHGSEDS

SEQ ID NO: 963 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQDAQLKSANTGNNERIINVSIKKLKRKPPSDNAGRRQKHRLTCPSCDSYEKKPPKEFLERFKSLLQKMIHQHLSSRTHGSEDS

SEQ ID NO: 964 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 965 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSTNAGGDQKHRLTCPSCDSYEKKPPKEFLERFKSLLQKMIHQHLSSRTHGSEDS

SEQ ID NO: 966 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSTNAGQGQKHRLTCPSCDSYEKKPPKEFLERFKSLLQKMIHQHLSSRTHGSEDS

SEQ ID NO: 967 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSTNPGRDQKHRLTCPSCDSYEKKPPKEFLERFKSLLQKMIHQHLSSRTHGSEDS

SEQ ID NO: 968 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSTNAGRDQKHRLTCPSCDSYEKKPPKEFLERFKSLLQKMIHQHLSSRTHGSEDS

SEQ ID NO: 969 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNPGRGQKHRLTCPSCDSYEKKPPKEFLERFKSLLQKMIHQHLSSRTHGSEDS

SEQ ID NO: 970 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGRRQKDTLTCPSCDSYEKKPPKEFLERFKSLLQKMIHQHLSSRTHGSEDS

SEQ ID NO: 971 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGGDQKHRLTCPSCDSYEKKPPKEFLERFKSLLQKMIHQHLSSRTHGSEDS

SEQ ID NO: 972 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKVPSTNAGRRQKHRLECPSCDSYEKKPPKEFLERFKSLLQKMIHQHLSSRTHGSEDS

SEQ ID NO: 973 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSDNAGRGQKHRLTCPSCDSYEKKPPKEFLERFKSLLQKMIHQHLSSRTHGSEDS

SEQ ID NO: 974 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGGRQKHRLTCPSCDSYEKKPPKEFLERFKSLLQKMIHQHLSSRTHGSEDS

SEQ ID NO: 975 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGGDQKHRLTCPSCDSYEKKPPKEFLERFKSLLQKMIHQHLSSRTHGSEDS

SEQ ID NO: 976 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSTNAGGGQKHRLTCPSCDSYEKKPPKEFLERFKSLLQKMIHQHLSSRTHGSEDS

SEQ ID NO: 977 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINESIKKLKRKPPSTNAGGRQKHRLTCPSCDSYEKKPPKEFLERFKSLLQKMIHQHLSSRTHGSEDS

SEQ ID NO: 978 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 979 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSTNAGGDQKHRLTCPSCDSYEKKPPKEFLERFKSLLQKMIHQHLSSRTHGSEDS

SEQ ID NO: 980 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGQRQKHTLTCPSCDSYEKKPPKEFLERFKSLLQKMIHQHLSSRTHGSEDS

SEQ ID NO: 981 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGQGQKHRLTCPSCDSYEKKPPKEFLERFKSLLQKMIHQHLSSRTHGSEDS

SEQ ID NO: 982 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGQRQKDRLTCPSCDSYEKKPPKEFLERFKSLLQKMIHQHLSSRTHGSEDS

SEQ ID NO: 983 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGQRQKHRLECPSCDSYEKKPPKEFLERFKSLLQKMIHQHLSSRTHGSEDS

SEQ ID NO: 984 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGQRQKDRLTCPSCDSYEKKPPKEFLERFKSLLQKMIHQHLSSRTHGSEDS

SEQ ID NO: 985 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINESIKKLKRKPPSTNAGRRQKHTLTCPSCDSYEKKPPKEFLERFKSLLQKMIHQHLSSRTHGSEDS

SEQ ID NO: 986 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGRDQKDRLTCPSCDSYEKKPPKEFLERFKSLLQKMIHQHLSSRTHGSEDS

SEQ ID NO: 987 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSDNAGGRQKHRLTCPSCDSYEKKPPKEFLERFKSLLQKMIHQHLSSRTHGSEDS

SEQ ID NO: 988 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGGDQKHRLTCPSCDSYEKKPPKEFLERFKSLLQKMIHQHLSSRTHGSEDS

SEQ ID NO: 989 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGQRQKHRLTCPSCDSYEKKPPKEFLERFKSLLQKMIHQHLSSRTHGSEDS

SEQ ID NO: 990 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGRDQKHTLTCPSCDSYEKKPPKEFLERFKSLLQKMIHQHLSSRTHGSEDS

SEQ ID NO: 991 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGQDQKHRLTCPSCDSYEKKPPKEFLERFKSLLQKMIHQHLSSRTHGSEDS

SEQ ID NO: 992 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGQGQKHRLTCPSCDSYEKKPPKEFLERFKSLLQKMIHQHLSSRTHGSEDS

SEQ ID NO: 993 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGGRQKDRLECPSCDSYEKKPPKEFLERFKSLLQKMIHQHLSSRTHGSEDS

SEQ ID NO: 994 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGQRQKDRLTCPSCDSYEKKPPKEFLERFKSLLQKMIHQHLSSRTHGSEDS

SEQ ID NO: 995 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSTNAGQGQKHRLTCPSCDSYEKKPPKEFLERFKSLLQKMIHQHLSSRTHGSEDS

SEQ ID NO: 996 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 997 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGQRQKDRLTCPSCDSYEKKPPKEFLERFKSLLQKMIHQHLSSRTHGSEDS

SEQ ID NO: 998 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGRGQKHTLTCPSCDSYEKKPPKEFLERFKSLLQKMIHQHLSSRTHGSEDS

SEQ ID NO: 999 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINESIKKLKRKPPSDNAGRRQKHRLTCPSCDSYEKKPPKEFLERFKSLLQKMIHQHLSSRTHGSEDS

SEQ ID NO: 1000 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRDQKHTLECPSCDSYEKKPPKEFLERFKSLLQKMIHQHLSSRTHGSEDS

SEQ ID NO: 1001 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGGDQKDRLTCPSCDSYEKKPPKEFLERFKSLLQKMIHQHLSSRTHGSEDS

SEQ ID NO: 1002 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGGDQKHRLTCPSCDSYEKKPPKEFLERFKSLLQKMIHQHLSSRTHGSEDS

SEQ ID NO: 1003 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGRDQKHRLECPSCDSYEKKPPKEFLERFKSLLQKMIHQHLSSRTHGSEDS

SEQ ID NO: 1004 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGRDQKHRLECPSCDSYEKKPPKEFLERFKSLLQKMIHQHLSSRTHGSEDS

SEQ ID NO: 1005 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 1006 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGRRQKDTLTCPSCDSYEKKPPKEFLERFKSLLQKMIHQHLSSRTHGSEDS

SEQ ID NO: 1007 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGQGQKHRLTCPSCDSYEKKPPKEFLERFKSLLQKMIHQHLSSRTHGSEDS

SEQ ID NO: 1008 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSDNAGGRQKHRLTCPSCDSYEKKPPKEFLERFKSLLQKMIHQHLSSRTHGSEDS

SEQ ID NO: 1009 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGRRQKDRLECPSCDSYEKKPPKEFLERFKSLLQKMIHQHLSSRTHGSEDS

SEQ ID NO: 1010 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNPGQRQKHRLTCPSCDSYEKKPPKEFLERFKSLLQKMIHQHLSSRTHGSEDS

SEQ ID NO: 1011 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSTNAGQGQKHRLTCPSCDSYEKKPPKEFLERFKSLLQKMIHQHLSSRTHGSEDS

SEQ ID NO: 1012 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGRDQKHRLECPSCDSYEKKPPKEFLERFKSLLQKMIHQHLSSRTHGSEDS

SEQ ID NO: 1013 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKVPSTNAGRGQKHRLTCPSCDSYEKKPPKEFLERFKSLLQKMIHQHLSSRTHGSEDS

SEQ ID NO: 1014 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNPGRDQKHRLTCPSCDSYEKKPPKEFLERFKSLLQKMIHQHLSSRTHGSEDS

SEQ ID NO: 1015 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSDNAGQRQKHRLTCPSCDSYEKKPPKEFLERFKSLLQKMIHQHLSSRTHGSEDS

SEQ ID NO: 1016 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKVPSTNAGRDQKHRLTCPSCDSYEKKPPKEFLERFKSLLQKMIHQHLSSRTHGSEDS

SEQ ID NO: 1017 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGRDQKHRLTCPSCDSYEKKPPKEFLERFKSLLQKMIHQHLSSRTHGSEDS

SEQ ID NO: 1018 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKVPSDNAGRRQKHRLTCPSCDSYEKKPPKEFLERFKSLLQKMIHQHLSSRTHGSEDS

SEQ ID NO: 1019 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINESIKKLKRKPPSTNAGGRQKHRLTCPSCDSYEKKPPKEFLERFKSLLQKMIHQHLSSRTHGSEDS

SEQ ID NO: 1020 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKVPSTNAGRRQKHTLTCPSCDSYEKKPPKEFLERFKSLLQKMIHQHLSSRTHGSEDS

SEQ ID NO: 1021 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGRGQKDRLTCPSCDSYEKKPPKEFLERFKSLLQKMIHQHLSSRTHGSEDS

SEQ ID NO: 1022 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGQGQKHRLTCPSCDSYEKKPPKEFLERFKSLLQKMIHQHLSSRTHGSEDS

SEQ ID NO: 1023 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGQDQKHRLTCPSCDSYEKKPPKEFLERFKSLLQKMIHQHLSSRTHGSEDS

SEQ ID NO: 1024 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGQGQKHRLTCPSCDSYEKKPPKEFLERFKSLLQKMIHQHLSSRTHGSEDS

SEQ ID NO: 1025 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSTNAGRDQKHRLTCPSCDSYEKKPPKEFLERFKSLLQKMIHQHLSSRTHGSEDS

SEQ ID NO: 1026 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGRRQKDTLTCPSCDSYEKKPPKEFLERFKSLLQKMIHQHLSSRTHGSEDS

SEQ ID NO: 1027 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGGRQKDRLTCPSCDSYEKKPPKEFLERFKSLLQKMIHQHLSSRTHGSEDS

SEQ ID NO: 1028 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKVPSTNAGRGQKHRLTCPSCDSYEKKPPKEFLERFKSLLQKMIHQHLSSRTHGSEDS

SEQ ID NO: 1029 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGQDQKHTLTCPSCDSYEKKPPKEFLERFKSLLQKMIHQHLSSRTHGSEDS

SEQ ID NO: 1030 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGRDQKHTLTCPSCDSYEKKPPKEFLERFKSLLQKMIHQHLSSRTHGSEDS

SEQ ID NO: 1031 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGGDQKHRLTCPSCDSYEKKPPKEFLERFKSLLQKMIHQHLSSRTHGSEDS

SEQ ID NO: 1032 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGRDQKHRLECPSCDSYEKKPPKEFLERFKSLLQKMIHQHLSSRTHGSEDS

SEQ ID NO: 1033 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGQRQKDRLTCPSCDSYEKKPPKEFLERFKSLLQKMIHQHLSSRTHGSEDS

SEQ ID NO: 1034 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNPGRDQKHRLTCPSCDSYEKKPPKEFLERFKSLLQKMIHQHLSSRTHGSEDS

SEQ ID NO: 1035 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGGRQKDTLTCPSCDSYEKKPPKEFLERFKSLLQKMIHQHLSSRTHGSEDS

SEQ ID NO: 1036 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQDAQLKSANTGNNERIINVSIKKLKRKPPSDNAGRRQKHRLTCPSCDSYEKKPPKEFLERFKSLLQKMIHQHLSSRTHGSEDS

SEQ ID NO: 1037 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSTNPGRDQKHRLTCPSCDSYEKKPPKEFLERFKSLLQKMIHQHLSSRTHGSEDS

SEQ ID NO: 1038 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGGGQKHRLTCPSCDSYEKKPPKEFLERFKSLLQKMIHQHLSSRTHGSEDS

SEQ ID NO: 1039 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGQRQKHTLECPSCDSYEKKPPKEFLERFKSLLQKMIHQHLSSRTHGSEDS

SEQ ID NO: 1040 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSDNAGRGQKHRLTCPSCDSYEKKPPKEFLERFKSLLQKMIHQHLSSRTHGSEDS

SEQ ID NO: 1041 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 1042 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGQRQKHTLTCPSCDSYEKKPPKEFLERFKSLLQKMIHQHLSSRTHGSEDS

SEQ ID NO: 1043 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKVPSTNAGQRQKHRLTCPSCDSYEKKPPKEFLERFKSLLQKMIHQHLSSRTHGSEDS

SEQ ID NO: 1044 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSTNPGGRQKHRLTCPSCDSYEKKPPKEFLERFKSLLQKMIHQHLSSRTHGSEDS

SEQ ID NO: 1045 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGRGQKHRLTCPSCDSYEKKPPKEFLERFKSLLQKMIHQHLSSRTHGSEDS

SEQ ID NO: 1046 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKVPSTNAGRDQKHRLTCPSCDSYEKKPPKEFLERFKSLLQKMIHQHLSSRTHGSEDS

SEQ ID NO: 1047 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGQDQKHRLECPSCDSYEKKPPKEFLERFKSLLQKMIHQHLSSRTHGSEDS

SEQ ID NO: 1048 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGQGQKHRLTCPSCDSYEKKPPKEFLERFKSLLQKMIHQHLSSRTHGSEDS

SEQ ID NO: 1049 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSDNAGRDQKHRLTCPSCDSYEKKPPKEFLERFKSLLQKMIHQHLSSRTHGSEDS

SEQ ID NO: 1050 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGGGQKHRLTCPSCDSYEKKPPKEFLERFKSLLQKMIHQHLSSRTHGSEDS

SEQ ID NO: 1051 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSTNPGQRQKHRLTCPSCDSYEKKPPKEFLERFKSLLQKMIHQHLSSRTHGSEDS

SEQ ID NO: 1052 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSDNAGQRQKHRLTCPSCDSYEKKPPKEFLERFKSLLQKMIHQHLSSRTHGSEDS

SEQ ID NO: 1053 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGRDQKHRLTCPSCDSYEKKPPKEFLERFKSLLQKMIHQHLSSRTHGSEDS

SEQ ID NO: 1054 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGGDQKHRLTCPSCDSYEKKPPKEFLERFKSLLQKMIHQHLSSRTHGSEDS

SEQ ID NO: 1055 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSDNAGRDQKHRLTCPSCDSYEKKPPKEFLERFKSLLQKMIHQHLSSRTHGSEDS

SEQ ID NO: 1056 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSDNAGRRQKDRLTCPSCDSYEKKPPKEFLERFKSLLQKMIHQHLSSRTHGSEDS

SEQ ID NO: 1057 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGGRQKHTLTCPSCDSYEKKPPKEFLERFKSLLQKMIHQHLSSRTHGSEDS

SEQ ID NO: 1058 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGGRQKDRLTCPSCDSYEKKPPKEFLERFKSLLQKMIHQHLSSRTHGSEDS

SEQ ID NO: 1059 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSDNAGRGQKHRLTCPSCDSYEKKPPKEFLERFKSLLQKMIHQHLSSRTHGSEDS

SEQ ID NO: 1060 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSDNAGRRQKHTLTCPSCDSYEKKPPKEFLERFKSLLQKMIHQHLSSRTHGSEDS

SEQ ID NO: 1061 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSDNAGRRQKDRLTCPSCDSYEKKPPKEFLERFKSLLQKMIHQHLSSRTHGSEDS

SEQ ID NO: 1062 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGGGQKHTLTCPSCDSYEKKPPKEFLERFKSLLQKMIHQHLSSRTHGSEDS

SEQ ID NO: 1063 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQDAQLKSANTGNNERIINVSIKKLKRKPPSTNAGGRQKHRLTCPSCDSYEKKPPKEFLERFKSLLQKMIHQHLSSRTHGSEDS

SEQ ID NO: 1064 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGGRQKHTLTCPSCDSYEKKPPKEFLERFKSLLQKMIHQHLSSRTHGSEDS

SEQ ID NO: 1065 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGGGQKHRLTCPSCDSYEKKPPKEFLERFKSLLQKMIHQHLSSRTHGSEDS

SEQ ID NO: 1066 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGGRQKHRLECPSCDSYEKKPPKEFLERFKSLLQKMIHQHLSSRTHGSEDS

SEQ ID NO: 1067 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGQRQKHTLTCPSCDSYEKKPPKEFLERFKSLLQKMIHQHLSSRTHGSEDS

SEQ ID NO: 1068 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQDAQLKSANTGNNERIINVSIKKLKRKPPSTNAGRDQKHRLTCPSCDSYEKKPPKEFLERFKSLLQKMIHQHLSSRTHGSEDS

SEQ ID NO: 1069 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGQRQKDRLTCPSCDSYEKKPPKEFLERFKSLLQKMIHQHLSSRTHGSEDS

SEQ ID NO: 1070 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKVPSTNAGGRQKHRLTCPSCDSYEKKPPKEFLERFKSLLQKMIHQHLSSRTHGSEDS

SEQ ID NO: 1071 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGRRQKDRLECPSCDSYEKKPPKEFLERFKSLLQKMIHQHLSSRTHGSEDS

SEQ ID NO: 1072 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGGGQKHRLTCPSCDSYEKKPPKEFLERFKSLLQKMIHQHLSSRTHGSEDS

SEQ ID NO: 1073 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQDAQLKSANTGNNERIINVSIKKLKRKPPSTNAGRGQKHRLTCPSCDSYEKKPPKEFLERFKSLLQKMIHQHLSSRTHGSEDS

SEQ ID NO: 1074 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKVPSTNAGRGQKHRLTCPSCDSYEKKPPKEFLERFKSLLQKMIHQHLSSRTHGSEDS

SEQ ID NO: 1075 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINESIKKLKRKPPSTNAGRGQKHRLTCPSCDSYEKKPPKEFLERFKSLLQKMIHQHLSSRTHGSEDS

SEQ ID NO: 1076 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 1077 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGQGQKHRLECPSCDSYEKKPPKEFLERFKSLLQKMIHQHLSSRTHGSEDS

SEQ ID NO: 1078 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGGDQKHRLTCPSCDSYEKKPPKEFLERFKSLLQKMIHQHLSSRTHGSEDS

SEQ ID NO: 1079 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQDAQLKSANTGNNERIINVSIKKLKRKPPSTNAGQRQKHRLTCPSCDSYEKKPPKEFLERFKSLLQKMIHQHLSSRTHGSEDS

SEQ ID NO: 1080 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGRDQKDRLTCPSCDSYEKKPPKEFLERFKSLLQKMIHQHLSSRTHGSEDS

SEQ ID NO: 1081 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGGRQKDRLTCPSCDSYEKKPPKEFLERFKSLLQKMIHQHLSSRTHGSEDS

SEQ ID NO: 1082 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSDNAGRGQKHRLTCPSCDSYEKKPPKEFLERFKSLLQKMIHQHLSSRTHGSEDS

SEQ ID NO: 1083 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINESIKKLKRKPPSTNAGRRQKDRLTCPSCDSYEKKPPKEFLERFKSLLQKMIHQHLSSRTHGSEDS

SEQ ID NO: 1084 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGQRQKDRLECPSCDSYEKKPPKEFLERFKSLLQKMIHQHLSSRTHGSEDS

SEQ ID NO: 1085 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNPGRDQKHRLTCPSCDSYEKKPPKEFLERFKSLLQKMIHQHLSSRTHGSEDS

SEQ ID NO: 1086 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQDAQLKSANTGNNERIINVSIKKLKRKPPSTNAGRDQKHRLTCPSCDSYEKKPPKEFLERFKSLLQKMIHQHLSSRTHGSEDS

SEQ ID NO: 1087 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGGGQKHRLTCPSCDSYEKKPPKEFLERFKSLLQKMIHQHLSSRTHGSEDS

SEQ ID NO: 1088 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGQGQKHTLTCPSCDSYEKKPPKEFLERFKSLLQKMIHQHLSSRTHGSEDS

SEQ ID NO: 1089 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 1090 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGRRQKDRLECPSCDSYEKKPPKEFLERFKSLLQKMIHQHLSSRTHGSEDS

SEQ ID NO: 1091 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRDQKHTLECPSCDSYEKKPPKEFLERFKSLLQKMIHQHLSSRTHGSEDS

SEQ ID NO: 1092 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSDNAGRDQKHRLTCPSCDSYEKKPPKEFLERFKSLLQKMIHQHLSSRTHGSEDS

SEQ ID NO: 1093 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINESIKKLKRKPPSTNPGRRQKHRLTCPSCDSYEKKPPKEFLERFKSLLQKMIHQHLSSRTHGSEDS

SEQ ID NO: 1094 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGGRQKHTLTCPSCDSYEKKPPKEFLERFKSLLQKMIHQHLSSRTHGSEDS

SEQ ID NO: 1095 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGRDQKDRLTCPSCDSYEKKPPKEFLERFKSLLQKMIHQHLSSRTHGSEDS

SEQ ID NO: 1096 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSDNAGRGQKHRLTCPSCDSYEKKPPKEFLERFKSLLQKMIHQHLSSRTHGSEDS

SEQ ID NO: 1097 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGQDQKDRLTCPSCDSYEKKPPKEFLERFKSLLQKMIHQHLSSRTHGSEDS

SEQ ID NO: 1098 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKVPSTNAGGRQKHRLTCPSCDSYEKKPPKEFLERFKSLLQKMIHQHLSSRTHGSEDS

SEQ ID NO: 1099 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKVPSTNAGRDQKHRLTCPSCDSYEKKPPKEFLERFKSLLQKMIHQHLSSRTHGSEDS

SEQ ID NO: 1100 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGGRQKDRLTCPSCDSYEKKPPKEFLERFKSLLQKMIHQHLSSRTHGSEDS

SEQ ID NO: 1101 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINESIKKLKRKPPSTNAGRRQKHRLECPSCDSYEKKPPKEFLERFKSLLQKMIHQHLSSRTHGSEDS

SEQ ID NO: 1102 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSDNAGRRQKDRLTCPSCDSYEKKPPKEFLERFKSLLQKMIHQHLSSRTHGSEDS

SEQ ID NO: 1103 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGRDQKHTLTCPSCDSYEKKPPKEFLERFKSLLQKMIHQHLSSRTHGSEDS

SEQ ID NO: 1104 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINESIKKLKRKPPSTNAGRDQKHRLTCPSCDSYEKKPPKEFLERFKSLLQKMIHQHLSSRTHGSEDS

SEQ ID NO: 1105 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGQDQKHRLECPSCDSYEKKPPKEFLERFKSLLQKMIHQHLSSRTHGSEDS

SEQ ID NO: 1106 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGRDQKHTLTCPSCDSYEKKPPKEFLERFKSLLQKMIHQHLSSRTHGSEDS

SEQ ID NO: 1107 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 1108 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNPGRDQKHRLTCPSCDSYEKKPPKEFLERFKSLLQKMIHQHLSSRTHGSEDS

SEQ ID NO: 1109 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINESIKKLKRKPPSTNPGRRQKHRLTCPSCDSYEKKPPKEFLERFKSLLQKMIHQHLSSRTHGSEDS

SEQ ID NO: 1110 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGRDQKDRLTCPSCDSYEKKPPKEFLERFKSLLQKMIHQHLSSRTHGSEDS

SEQ ID NO: 1111 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGRDQKDRLTCPSCDSYEKKPPKEFLERFKSLLQKMIHQHLSSRTHGSEDS

SEQ ID NO: 1112 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKVPSDNAGRRQKHRLTCPSCDSYEKKPPKEFLERFKSLLQKMIHQHLSSRTHGSEDS

SEQ ID NO: 1113 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNPGRRQKDRLTCPSCDSYEKKPPKEFLERFKSLLQKMIHQHLSSRTHGSEDS

SEQ ID NO: 1114 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGRDQKDRLTCPSCDSYEKKPPKEFLERFKSLLQKMIHQHLSSRTHGSEDS

SEQ ID NO: 1115 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRGQKHTLECPSCDSYEKKPPKEFLERFKSLLQKMIHQHLSSRTHGSEDS

SEQ ID NO: 1116 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGGGQKHRLTCPSCDSYEKKPPKEFLERFKSLLQKMIHQHLSSRTHGSEDS

SEQ ID NO: 1117 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGRGQKHRLECPSCDSYEKKPPKEFLERFKSLLQKMIHQHLSSRTHGSEDS

SEQ ID NO: 1118 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSTNAGRGQKHRLTCPSCDSYEKKPPKEFLERFKSLLQKMIHQHLSSRTHGSEDS

SEQ ID NO: 1119 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGRGQKHRLECPSCDSYEKKPPKEFLERFKSLLQKMIHQHLSSRTHGSEDS

SEQ ID NO: 1120 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSTNPGRGQKHRLTCPSCDSYEKKPPKEFLERFKSLLQKMIHQHLSSRTHGSEDS

SEQ ID NO: 1121 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGRRQKDRLECPSCDSYEKKPPKEFLERFKSLLQKMIHQHLSSRTHGSEDS

SEQ ID NO: 1122 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGQRQKDTLTCPSCDSYEKKPPKEFLERFKSLLQKMIHQHLSSRTHGSEDS

SEQ ID NO: 1123 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSDNAGRGQKHRLTCPSCDSYEKKPPKEFLERFKSLLQKMIHQHLSSRTHGSEDS

SEQ ID NO: 1124 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSTNPGRGQKHRLTCPSCDSYEKKPPKEFLERFKSLLQKMIHQHLSSRTHGSEDS

SEQ ID NO: 1125 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGGGQKDRLTCPSCDSYEKKPPKEFLERFKSLLQKMIHQHLSSRTHGSEDS

SEQ ID NO: 1126 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGGRQKDRLTCPSCDSYEKKPPKEFLERFKSLLQKMIHQHLSSRTHGSEDS

SEQ ID NO: 1127 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGGRQKDRLECPSCDSYEKKPPKEFLERFKSLLQKMIHQHLSSRTHGSEDS

SEQ ID NO: 1128 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNPGRDQKHRLTCPSCDSYEKKPPKEFLERFKSLLQKMIHQHLSSRTHGSEDS

SEQ ID NO: 1129 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 1130 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINESIKKLKRKPPSTNAGRDQKHRLTCPSCDSYEKKPPKEFLERFKSLLQKMIHQHLSSRTHGSEDS

SEQ ID NO: 1131 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGRDQKHRLECPSCDSYEKKPPKEFLERFKSLLQKMIHQHLSSRTHGSEDS

SEQ ID NO: 1132 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 1133 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINESIKKLKRKPPSTNAGGRQKHRLTCPSCDSYEKKPPKEFLERFKSLLQKMIHQHLSSRTHGSEDS

SEQ ID NO: 1134 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKRKPPSTNAGRDQKHRLTCPSCDSYEKKPPKEFLERFKSLLQKMIHQHLSSRTHGSEDS

SEQ ID NO: 1135 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGRGQKDRLTCPSCDSYEKKPPKEFLERFKSLLQKMIHQHLSSRTHGSEDS

SEQ ID NO: 1136 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGGRQKDRLTCPSCDSYEKKPPKEFLERFKSLLQKMIHQHLSSRTHGSEDS

SEQ ID NO: 1137 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRGQKHTLTCPSCDSYEKKPPKEFLERFKSLLQKMIHQHLSSRTHGSEDS

SEQ ID NO: 1138 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGQRQKHRLTCPSCDSYEKKPPKEFLERFKSLLQKMIHQHLSSRTHGSEDS

SEQ ID NO: 1139 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGRDQKHTLTCPSCDSYEKKPPKEFLERFKSLLQKMIHQHLSSRTHGSEDS

SEQ ID NO: 1140 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSDNAGRRQKHTLTCPSCDSYEKKPPKEFLERFKSLLQKMIHQHLSSRTHGSEDS

SEQ ID NO: 1141 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGRGQKHRLTCPSCDSYEKKPPKEFLERFKSLLQKMIHQHLSSRTHGSEDS

SEQ ID NO: 1142 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSDNAGQRQKHRLTCPSCDSYEKKPPKEFLERFKSLLQKMIHQHLSSRTHGSEDS

SEQ ID NO: 1143 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKVPSTNAGRDQKHRLTCPSCDSYEKKPPKEFLERFKSLLQKMIHQHLSSRTHGSEDS

SEQ ID NO: 1144 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGQRQKDTLTCPSCDSYEKKPPKEFLERFKSLLQKMIHQHLSSRTHGSEDS

SEQ ID NO: 1145 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGGRQKHRLTCPSCDSYEKKPPKEFLERFKSLLQKMIHQHLSSRTHGSEDS

SEQ ID NO: 1146 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGRRQKDTLTCPSCDSYEKKPPKEFLERFKSLLQKMIHQHLSSRTHGSEDS

SEQ ID NO: 1147 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGGDQKHRLECPSCDSYEKKPPKEFLERFKSLLQKMIHQHLSSRTHGSEDS

SEQ ID NO: 1148 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGRGQKDRLTCPSCDSYEKKPPKEFLERFKSLLQKMIHQHLSSRTHGSEDS

SEQ ID NO: 1149 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGQDQKHTLTCPSCDSYEKKPPKEFLERFKSLLQKMIHQHLSSRTHGSEDS

SEQ ID NO: 1150 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSDNAGRRQKHTLTCPSCDSYEKKPPKEFLERFKSLLQKMIHQHLSSRTHGSEDS

SEQ ID NO: 1151 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRGQKDRLECPSCDSYEKKPPKEFLERFKSLLQKMIHQHLSSRTHGSEDS

SEQ ID NO: 1152 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGGRQKDTLTCPSCDSYEKKPPKEFLERFKSLLQKMIHQHLSSRTHGSEDS

SEQ ID NO: 1153 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGRGQKHTLTCPSCDSYEKKPPKEFLERFKSLLQKMIHQHLSSRTHGSEDS

SEQ ID NO: 1154 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGRDQKHRLECPSCDSYEKKPPKEFLERFKSLLQKMIHQHLSSRTHGSEDS

SEQ ID NO: 1155 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSDNAGRGQKHRLTCPSCDSYEKKPPKEFLERFKSLLQKMIHQHLSSRTHGSEDS

SEQ ID NO: 1156 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKVPSTNAGQRQKHRLTCPSCDSYEKKPPKEFLERFKSLLQKMIHQHLSSRTHGSEDS

SEQ ID NO: 1157 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKRKPPSTNAGGRQKHRLTCPSCDSYEKKPPKEFLERFKSLLQKMIHQHLSSRTHGSEDS

SEQ ID NO: 1158 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSDNAGRDQKHRLTCPSCDSYEKKPPKEFLERFKSLLQKMIHQHLSSRTHGSEDS

SEQ ID NO: 1159 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSTNPGRGQKHRLTCPSCDSYEKKPPKEFLERFKSLLQKMIHQHLSSRTHGSEDS

SEQ ID NO: 1160 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINESIKKLKRKPPSTNAGQRQKHRLTCPSCDSYEKKPPKEFLERFKSLLQKMIHQHLSSRTHGSEDS

SEQ ID NO: 1161 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGRRQKHTLTCPSCDSYEKKPPKEFLERFKSLLQKMIHQHLSSRTHGSEDS

SEQ ID NO: 1162 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRDQKHRLECPSCDSYEKKPPKEFLERFKSLLQKMIHQHLSSRTHGSEDS

SEQ ID NO: 1163 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSDNAGRRQKHRLECPSCDSYEKKPPKEFLERFKSLLQKMIHQHLSSRTHGSEDS

SEQ ID NO: 1164 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGRGQKHTLTCPSCDSYEKKPPKEFLERFKSLLQKMIHQHLSSRTHGSEDS

SEQ ID NO: 1165 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGRGQKHRLECPSCDSYEKKPPKEFLERFKSLLQKMIHQHLSSRTHGSEDS

SEQ ID NO: 1166 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGRRQKDRLECPSCDSYEKKPPKEFLERFKSLLQKMIHQHLSSRTHGSEDS

SEQ ID NO: 1167 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSDNAGQRQKHRLTCPSCDSYEKKPPKEFLERFKSLLQKMIHQHLSSRTHGSEDS

SEQ ID NO: 1168 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGGGQKHTLTCPSCDSYEKKPPKEFLERFKSLLQKMIHQHLSSRTHGSEDS

SEQ ID NO: 1169 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGQRQKDRLTCPSCDSYEKKPPKEFLERFKSLLQKMIHQHLSSRTHGSEDS

SEQ ID NO: 1170 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNPGRRQKDRLTCPSCDSYEKKPPKEFLERFKSLLQKMIHQHLSSRTHGSEDS

SEQ ID NO: 1171 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 1172 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGGRQKDRLTCPSCDSYEKKPPKEFLERFKSLLQKMIHQHLSSRTHGSEDS

SEQ ID NO: 1173 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNPGRDQKHRLTCPSCDSYEKKPPKEFLERFKSLLQKMIHQHLSSRTHGSEDS

SEQ ID NO: 1174 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSTNAGRDQKHRLTCPSCDSYEKKPPKEFLERFKSLLQKMIHQHLSSRTHGSEDS

SEQ ID NO: 1175 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 1176 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSDNAGGRQKHRLTCPSCDSYEKKPPKEFLERFKSLLQKMIHQHLSSRTHGSEDS

SEQ ID NO: 1177 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGGGQKHRLTCPSCDSYEKKPPKEFLERFKSLLQKMIHQHLSSRTHGSEDS

SEQ ID NO: 1178 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRDQKDRLECPSCDSYEKKPPKEFLERFKSLLQKMIHQHLSSRTHGSEDS

SEQ ID NO: 1179 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGRGQKHTLTCPSCDSYEKKPPKEFLERFKSLLQKMIHQHLSSRTHGSEDS

SEQ ID NO: 1180 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 1181 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGGRQKHRLECPSCDSYEKKPPKEFLERFKSLLQKMIHQHLSSRTHGSEDS

SEQ ID NO: 1182 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSTNAGGDQKHRLTCPSCDSYEKKPPKEFLERFKSLLQKMIHQHLSSRTHGSEDS

SEQ ID NO: 1183 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGGRQKHTLTCPSCDSYEKKPPKEFLERFKSLLQKMIHQHLSSRTHGSEDS

SEQ ID NO: 1184 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSTNPGRGQKHRLTCPSCDSYEKKPPKEFLERFKSLLQKMIHQHLSSRTHGSEDS

SEQ ID NO: 1185 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGGRQKDRLTCPSCDSYEKKPPKEFLERFKSLLQKMIHQHLSSRTHGSEDS

SEQ ID NO: 1186 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGRGQKHRLTCPSCDSYEKKPPKEFLERFKSLLQKMIHQHLSSRTHGSEDS

SEQ ID NO: 1187 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGRRQKHTLECPSCDSYEKKPPKEFLERFKSLLQKMIHQHLSSRTHGSEDS

SEQ ID NO: 1188 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 1189 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGRGQKDRLTCPSCDSYEKKPPKEFLERFKSLLQKMIHQHLSSRTHGSEDS

SEQ ID NO: 1190 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGGGQKHRLECPSCDSYEKKPPKEFLERFKSLLQKMIHQHLSSRTHGSEDS

SEQ ID NO: 1191 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGRRQKDTLTCPSCDSYEKKPPKEFLERFKSLLQKMIHQHLSSRTHGSEDS

SEQ ID NO: 1192 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGRDQKHRLTCPSCDSYEKKPPKEFLERFKSLLQKMIHQHLSSRTHGSEDS

SEQ ID NO: 1193 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINESIKKLKRKPPSTNAGRDQKHRLTCPSCDSYEKKPPKEFLERFKSLLQKMIHQHLSSRTHGSEDS

SEQ ID NO: 1194 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQDAQLKSANTGNNERIINVSIKKLKRKPPSTNAGQRQKHRLTCPSCDSYEKKPPKEFLERFKSLLQKMIHQHLSSRTHGSEDS

SEQ ID NO: 1195 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGRDQKHRLTCPSCDSYEKKPPKEFLERFKSLLQKMIHQHLSSRTHGSEDS

SEQ ID NO: 1196 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQDAQLKSANTGNNERIINVSIKKLKRKPPSTNAGRDQKHRLTCPSCDSYEKKPPKEFLERFKSLLQKMIHQHLSSRTHGSEDS

SEQ ID NO: 1197 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGGDQKHTLTCPSCDSYEKKPPKEFLERFKSLLQKMIHQHLSSRTHGSEDS

SEQ ID NO: 1198 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNPGRGQKHRLTCPSCDSYEKKPPKEFLERFKSLLQKMIHQHLSSRTHGSEDS

SEQ ID NO: 1199 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGQDQKHRLTCPSCDSYEKKPPKEFLERFKSLLQKMIHQHLSSRTHGSEDS

SEQ ID NO: 1200 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGRDQKHTLTCPSCDSYEKKPPKEFLERFKSLLQKMIHQHLSSRTHGSEDS

SEQ ID NO: 1201 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRDQKHRLTCPSCDSYEKKPPKEFLERFKSLLQKMIHQHLSSRTHGSEDS

SEQ ID NO: 1202 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGRRQKDRLECPSCDSYEKKPPKEFLERFKSLLQKMIHQHLSSRTHGSEDS

SEQ ID NO: 1203 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSDNAGRDQKHRLTCPSCDSYEKKPPKEFLERFKSLLQKMIHQHLSSRTHGSEDS

SEQ ID NO: 1204 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGGRQKHTLTCPSCDSYEKKPPKEFLERFKSLLQKMIHQHLSSRTHGSEDS

SEQ ID NO: 1205 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINESIKKLKRKPPSTNAGQRQKHRLTCPSCDSYEKKPPKEFLERFKSLLQKMIHQHLSSRTHGSEDS

SEQ ID NO: 1206 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINESIKKLKRKPPSTNAGGRQKHRLTCPSCDSYEKKPPKEFLERFKSLLQKMIHQHLSSRTHGSEDS

SEQ ID NO: 1207 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGQGQKHRLTCPSCDSYEKKPPKEFLERFKSLLQKMIHQHLSSRTHGSEDS

SEQ ID NO: 1208 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRRQKDTLECPSCDSYEKKPPKEFLERFKSLLQKMIHQHLSSRTHGSEDS

SEQ ID NO: 1209 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGRRQKHTLECPSCDSYEKKPPKEFLERFKSLLQKMIHQHLSSRTHGSEDS

SEQ ID NO: 1210 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGQRQKDRLTCPSCDSYEKKPPKEFLERFKSLLQKMIHQHLSSRTHGSEDS

SEQ ID NO: 1211 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKVPSDNAGRRQKHRLTCPSCDSYEKKPPKEFLERFKSLLQKMIHQHLSSRTHGSEDS

SEQ ID NO: 1212 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGGRQKHRLTCPSCDSYEKKPPKEFLERFKSLLQKMIHQHLSSRTHGSEDS

SEQ ID NO: 1213 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRRQKDTLECPSCDSYEKKPPKEFLERFKSLLQKMIHQHLSSRTHGSEDS

SEQ ID NO: 1214 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSDNAGQDQKHRLTCPSCDSYEKKPPKEFLERFKSLLQKMIHQHLSSRTHGSEDS

SEQ ID NO: 1215 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGRRQKDTLTCPSCDSYEKKPPKEFLERFKSLLQKMIHQHLSSRTHGSEDS

SEQ ID NO: 1216 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGRGQKHTLTCPSCDSYEKKPPKEFLERFKSLLQKMIHQHLSSRTHGSEDS

SEQ ID NO: 1217 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGRGQKHTLTCPSCDSYEKKPPKEFLERFKSLLQKMIHQHLSSRTHGSEDS

SEQ ID NO: 1218 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRDQKHTLTCPSCDSYEKKPPKEFLERFKSLLQKMIHQHLSSRTHGSEDS

SEQ ID NO: 1219 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGGRQKHTLECPSCDSYEKKPPKEFLERFKSLLQKMIHQHLSSRTHGSEDS

SEQ ID NO: 1220 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGRDQKHRLTCPSCDSYEKKPPKEFLERFKSLLQKMIHQHLSSRTHGSEDS

SEQ ID NO: 1221 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKVPSTNAGQRQKHRLTCPSCDSYEKKPPKEFLERFKSLLQKMIHQHLSSRTHGSEDS

SEQ ID NO: 1222 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRDQKHRLECPSCDSYEKKPPKEFLERFKSLLQKMIHQHLSSRTHGSEDS

SEQ ID NO: 1223 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSTNAGRDQKHRLTCPSCDSYEKKPPKEFLERFKSLLQKMIHQHLSSRTHGSEDS

SEQ ID NO: 1224 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGRRQKHTLECPSCDSYEKKPPKEFLERFKSLLQKMIHQHLSSRTHGSEDS

SEQ ID NO: 1225 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSDNPGRRQKHRLTCPSCDSYEKKPPKEFLERFKSLLQKMIHQHLSSRTHGSEDS

SEQ ID NO: 1226 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSTNPGGRQKHRLTCPSCDSYEKKPPKEFLERFKSLLQKMIHQHLSSRTHGSEDS

SEQ ID NO: 1227 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRDQKHTLTCPSCDSYEKKPPKEFLERFKSLLQKMIHQHLSSRTHGSEDS

SEQ ID NO: 1228 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKVPSTNAGRRQKDRLTCPSCDSYEKKPPKEFLERFKSLLQKMIHQHLSSRTHGSEDS

SEQ ID NO: 1229 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGGGQKHRLTCPSCDSYEKKPPKEFLERFKSLLQKMIHQHLSSRTHGSEDS

SEQ ID NO: 1230 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRGQKDTLTCPSCDSYEKKPPKEFLERFKSLLQKMIHQHLSSRTHGSEDS

SEQ ID NO: 1231 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRGQKDRLTCPSCDSYEKKPPKEFLERFKSLLQKMIHQHLSSRTHGSEDS

SEQ ID NO: 1232 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSTNAGGRQKHRLTCPSCDSYEKKPPKEFLERFKSLLQKMIHQHLSSRTHGSEDS

SEQ ID NO: 1233 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQDAQLKSANTGNNERIINVSIKKLKRKPPSTNAGRDQKHRLTCPSCDSYEKKPPKEFLERFKSLLQKMIHQHLSSRTHGSEDS

SEQ ID NO: 1234 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQDAQLKSANTGNNERIINVSIKKLKRKPPSTNAGRGQKHRLTCPSCDSYEKKPPKEFLERFKSLLQKMIHQHLSSRTHGSEDS

SEQ ID NO: 1235 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGGRQKHTLECPSCDSYEKKPPKEFLERFKSLLQKMIHQHLSSRTHGSEDS

SEQ ID NO: 1236 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNPGRRQKDRLTCPSCDSYEKKPPKEFLERFKSLLQKMIHQHLSSRTHGSEDS

SEQ ID NO: 1237 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGQDQKHRLTCPSCDSYEKKPPKEFLERFKSLLQKMIHQHLSSRTHGSEDS

SEQ ID NO: 1238 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGRRQKDTLTCPSCDSYEKKPPKEFLERFKSLLQKMIHQHLSSRTHGSEDS

SEQ ID NO: 1239 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGRRQKDRLTCPSCDSYEKKPPKEFLERFKSLLQKMIHQHLSSRTHGSEDS

SEQ ID NO: 1240 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQDAQLKSANTGNNERIINVSIKKLKRKPPSTNPGRRQKHRLTCPSCDSYEKKPPKEFLERFKSLLQKMIHQHLSSRTHGSEDS

SEQ ID NO: 1241 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGGRQKHRLECPSCDSYEKKPPKEFLERFKSLLQKMIHQHLSSRTHGSEDS

SEQ ID NO: 1242 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGRRQKHRLECPSCDSYEKKPPKEFLERFKSLLQKMIHQHLSSRTHGSEDS

SEQ ID NO: 1243 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQDAQLKSANTGNNERIINVSIKKLKRKVPSTNAGRRQKHRLTCPSCDSYEKKPPKEFLERFKSLLQKMIHQHLSSRTHGSEDS

SEQ ID NO: 1244 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGRDQKHRLECPSCDSYEKKPPKEFLERFKSLLQKMIHQHLSSRTHGSEDS

SEQ ID NO: 1245 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGGGQKDRLTCPSCDSYEKKPPKEFLERFKSLLQKMIHQHLSSRTHGSEDS

SEQ ID NO: 1246 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGGDQKHRLTCPSCDSYEKKPPKEFLERFKSLLQKMIHQHLSSRTHGSEDS

SEQ ID NO: 1247 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNPGRDQKHRLTCPSCDSYEKKPPKEFLERFKSLLQKMIHQHLSSRTHGSEDS

SEQ ID NO: 1248 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSTNAGQDQKHRLTCPSCDSYEKKPPKEFLERFKSLLQKMIHQHLSSRTHGSEDS

SEQ ID NO: 1249 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKVPSTNAGQRQKHRLTCPSCDSYEKKPPKEFLERFKSLLQKMIHQHLSSRTHGSEDS

SEQ ID NO: 1250 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINESIKKLKRKPPSTNAGRGQKHRLTCPSCDSYEKKPPKEFLERFKSLLQKMIHQHLSSRTHGSEDS

SEQ ID NO: 1251 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKVPSTNAGRGQKHRLTCPSCDSYEKKPPKEFLERFKSLLQKMIHQHLSSRTHGSEDS

SEQ ID NO: 1252 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGGRQKDRLTCPSCDSYEKKPPKEFLERFKSLLQKMIHQHLSSRTHGSEDS

SEQ ID NO: 1253 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRDQKHRLTCPSCDSYEKKPPKEFLERFKSLLQKMIHQHLSSRTHGSEDS

SEQ ID NO: 1254 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSDNAGRRQKHTLTCPSCDSYEKKPPKEFLERFKSLLQKMIHQHLSSRTHGSEDS

SEQ ID NO: 1255 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNAGGRQKHTLTCPSCDSYEKKPPKEFLERFKSLLQKMIHQHLSSRTHGSEDS

SEQ ID NO: 1256 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGQRQKHRLECPSCDSYEKKPPKEFLERFKSLLQKMIHQHLSSRTHGSEDS

SEQ ID NO: 1257 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSDNAGQRQKHRLTCPSCDSYEKKPPKEFLERFKSLLQKMIHQHLSSRTHGSEDS

SEQ ID NO: 1258 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSTNAGGGQKHRLTCPSCDSYEKKPPKEFLERFKSLLQKMIHQHLSSRTHGSEDS

SEQ ID NO: 1259 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKVPSDNAGRRQKHRLTCPSCDSYEKKPPKEFLERFKSLLQKMIHQHLSSRTHGSEDS

SEQ ID NO: 1260 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGGRQKHRLECPSCDSYEKKPPKEFLERFKSLLQKMIHQHLSSRTHGSEDS

SEQ ID NO: 1261 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNPGRRQKHRLECPSCDSYEKKPPKEFLERFKSLLQKMIHQHLSSRTHGSEDS

SEQ ID NO: 1262 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSDNAGGDQKHRLTCPSCDSYEKKPPKEFLERFKSLLQKMIHQHLSSRTHGSEDS

SEQ ID NO: 1263 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGRRQKDRLTCPSCDSYEKKPPKEFLERFKSLLQKMIHQHLSSRTHGSEDS

SEQ ID NO: 1264 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSDNAGRGQKHRLTCPSCDSYEKKPPKEFLERFKSLLQKMIHQHLSSRTHGSEDS

SEQ ID NO: 1265 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNPGRRQKHTLTCPSCDSYEKKPPKEFLERFKSLLQKMIHQHLSSRTHGSEDS

SEQ ID NO: 1266 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSDNAGRRQKDRLTCPSCDSYEKKPPKEFLERFKSLLQKMIHQHLSSRTHGSEDS

SEQ ID NO: 1267 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRDQKDTLTCPSCDSYEKKPPKEFLERFKSLLQKMIHQHLSSRTHGSEDS

SEQ ID NO: 1268 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSDNAGRGQKHRLTCPSCDSYEKKPPKEFLERFKSLLQKMIHQHLSSRTHGSEDS

SEQ ID NO: 1269 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINESIKKLKRKPPSTNAGQRQKHRLTCPSCDSYEKKPPKEFLERFKSLLQKMIHQHLSSRTHGSEDS

SEQ ID NO: 1270 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSDNAGRRQKHRLTCPSCDSYEKKPPKEFLERFKSLLQKMIHQHLSSRTHGSEDS

SEQ ID NO: 1271 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQDAQLKSANTGNNERIINVSIKKLKRKPPSTNAGGRQKHRLTCPSCDSYEKKPPKEFLERFKSLLQKMIHQHLSSRTHGSEDS

SEQ ID NO: 1272 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGRGQKHTLTCPSCDSYEKKPPKEFLERFKSLLQKMIHQHLSSRTHGSEDS

SEQ ID NO: 1273 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGGRQKHRLTCPSCDSYEKKPPKEFLERFKSLLQKMIHQHLSSRTHGSEDS

SEQ ID NO: 1274 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSTNAGGGQKHRLTCPSCDSYEKKPPKEFLERFKSLLQKMIHQHLSSRTHGSEDS

SEQ ID NO: 1275 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGRRQKDRLTCPSCDSYEKKPPKEFLERFKSLLQKMIHQHLSSRTHGSEDS

SEQ ID NO: 1276 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGGGQKHRLTCPSCDSYEKKPPKEFLERFKSLLQKMIHQHLSSRTHGSEDS

SEQ ID NO: 1277 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGQRQKHRLECPSCDSYEKKPPKEFLERFKSLLQKMIHQHLSSRTHGSEDS

SEQ ID NO: 1278 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGQDQKDRLTCPSCDSYEKKPPKEFLERFKSLLQKMIHQHLSSRTHGSEDS

SEQ ID NO: 1279 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGGRQKHTLTCPSCDSYEKKPPKEFLERFKSLLQKMIHQHLSSRTHGSEDS

SEQ ID NO: 1280 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGQGQKHRLTCPSCDSYEKKPPKEFLERFKSLLQKMIHQHLSSRTHGSEDS

SEQ ID NO: 1281 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNPGRGQKHRLTCPSCDSYEKKPPKEFLERFKSLLQKMIHQHLSSRTHGSEDS

SEQ ID NO: 1282 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGQRQKHTLTCPSCDSYEKKPPKEFLERFKSLLQKMIHQHLSSRTHGSEDS

SEQ ID NO: 1283 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSDNAGQRQKHRLTCPSCDSYEKKPPKEFLERFKSLLQKMIHQHLSSRTHGSEDS

SEQ ID NO: 1284 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKVPSTNAGRDQKHRLTCPSCDSYEKKPPKEFLERFKSLLQKMIHQHLSSRTHGSEDS

SEQ ID NO: 1285 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNPGRGQKHRLTCPSCDSYEKKPPKEFLERFKSLLQKMIHQHLSSRTHGSEDS

SEQ ID NO: 1286 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGRGQKHRLECPSCDSYEKKPPKEFLERFKSLLQKMIHQHLSSRTHGSEDS

SEQ ID NO: 1287 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSDNAGRRQKHRLECPSCDSYEKKPPKEFLERFKSLLQKMIHQHLSSRTHGSEDS

SEQ ID NO: 1288 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGRGQKHRLTCPSCDSYEKKPPKEFLERFKSLLQKMIHQHLSSRTHGSEDS

SEQ ID NO: 1289 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGGRQKHRLECPSCDSYEKKPPKEFLERFKSLLQKMIHQHLSSRTHGSEDS

SEQ ID NO: 1290 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSTNAGGDQKHRLTCPSCDSYEKKPPKEFLERFKSLLQKMIHQHLSSRTHGSEDS

SEQ ID NO: 1291 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGGDQKDRLTCPSCDSYEKKPPKEFLERFKSLLQKMIHQHLSSRTHGSEDS

SEQ ID NO: 1292 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNPGRRQKDRLTCPSCDSYEKKPPKEFLERFKSLLQKMIHQHLSSRTHGSEDS

SEQ ID NO: 1293 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGGRQKHTLTCPSCDSYEKKPPKEFLERFKSLLQKMIHQHLSSRTHGSEDS

SEQ ID NO: 1294 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRDQKDRLTCPSCDSYEKKPPKEFLERFKSLLQKMIHQHLSSRTHGSEDS

SEQ ID NO: 1295 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQDAQLKSANTGNNERIINVSIKKLKRKVPSTNAGRRQKHRLTCPSCDSYEKKPPKEFLERFKSLLQKMIHQHLSSRTHGSEDS

SEQ ID NO: 1296 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSTNAGGGQKHRLTCPSCDSYEKKPPKEFLERFKSLLQKMIHQHLSSRTHGSEDS

SEQ ID NO: 1297 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSTNAGRGQKHRLTCPSCDSYEKKPPKEFLERFKSLLQKMIHQHLSSRTHGSEDS

SEQ ID NO: 1298 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSTNPGQRQKHRLTCPSCDSYEKKPPKEFLERFKSLLQKMIHQHLSSRTHGSEDS

SEQ ID NO: 1299 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGQRQKHTLTCPSCDSYEKKPPKEFLERFKSLLQKMIHQHLSSRTHGSEDS

SEQ ID NO: 1300 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRDQKDRLTCPSCDSYEKKPPKEFLERFKSLLQKMIHQHLSSRTHGSEDS

SEQ ID NO: 1301 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGRDQKDRLTCPSCDSYEKKPPKEFLERFKSLLQKMIHQHLSSRTHGSEDS

SEQ ID NO: 1302 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGQRQKHRLECPSCDSYEKKPPKEFLERFKSLLQKMIHQHLSSRTHGSEDS

SEQ ID NO: 1303 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSDNAGQRQKHRLTCPSCDSYEKKPPKEFLERFKSLLQKMIHQHLSSRTHGSEDS

SEQ ID NO: 1304 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGQRQKHRLECPSCDSYEKKPPKEFLERFKSLLQKMIHQHLSSRTHGSEDS

SEQ ID NO: 1305 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSTNAGQRQKHRLTCPSCDSYEKKPPKEFLERFKSLLQKMIHQHLSSRTHGSEDS

SEQ ID NO: 1306 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNPGQRQKHRLTCPSCDSYEKKPPKEFLERFKSLLQKMIHQHLSSRTHGSEDS

SEQ ID NO: 1307 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGRRQKDRLECPSCDSYEKKPPKEFLERFKSLLQKMIHQHLSSRTHGSEDS

SEQ ID NO: 1308 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSTNPGGRQKHRLTCPSCDSYEKKPPKEFLERFKSLLQKMIHQHLSSRTHGSEDS

SEQ ID NO: 1309 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKVPSTNAGRRQKHRLECPSCDSYEKKPPKEFLERFKSLLQKMIHQHLSSRTHGSEDS

SEQ ID NO: 1310 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSDNAGRDQKHRLTCPSCDSYEKKPPKEFLERFKSLLQKMIHQHLSSRTHGSEDS

SEQ ID NO: 1311 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGRRQKHTLECPSCDSYEKKPPKEFLERFKSLLQKMIHQHLSSRTHGSEDS

SEQ ID NO: 1312 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGQGQKHRLTCPSCDSYEKKPPKEFLERFKSLLQKMIHQHLSSRTHGSEDS

SEQ ID NO: 1313 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRGQKDTLTCPSCDSYEKKPPKEFLERFKSLLQKMIHQHLSSRTHGSEDS

SEQ ID NO: 1314 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSDNAGRDQKHRLTCPSCDSYEKKPPKEFLERFKSLLQKMIHQHLSSRTHGSEDS

SEQ ID NO: 1315 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQDAQLKSANTGNNERIINVSIKKLKRKPPSTNAGQRQKHRLTCPSCDSYEKKPPKEFLERFKSLLQKMIHQHLSSRTHGSEDS

SEQ ID NO: 1316 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINESIKKLKRKPPSDNAGRRQKHRLTCPSCDSYEKKPPKEFLERFKSLLQKMIHQHLSSRTHGSEDS

SEQ ID NO: 1317 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSDNAGGRQKHRLTCPSCDSYEKKPPKEFLERFKSLLQKMIHQHLSSRTHGSEDS

SEQ ID NO: 1318 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGGDQKHRLTCPSCDSYEKKPPKEFLERFKSLLQKMIHQHLSSRTHGSEDS

SEQ ID NO: 1319 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSTNPGRDQKHRLTCPSCDSYEKKPPKEFLERFKSLLQKMIHQHLSSRTHGSEDS

SEQ ID NO: 1320 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSDNAGRRQKHRLECPSCDSYEKKPPKEFLERFKSLLQKMIHQHLSSRTHGSEDS

SEQ ID NO: 1321 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGQRQKHRLTCPSCDSYEKKPPKEFLERFKSLLQKMIHQHLSSRTHGSEDS

SEQ ID NO: 1322 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGRGQKHTLTCPSCDSYEKKPPKEFLERFKSLLQKMIHQHLSSRTHGSEDS

SEQ ID NO: 1323 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRGQKHTLECPSCDSYEKKPPKEFLERFKSLLQKMIHQHLSSRTHGSEDS

SEQ ID NO: 1324 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGRDQKHRLECPSCDSYEKKPPKEFLERFKSLLQKMIHQHLSSRTHGSEDS

SEQ ID NO: 1325 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGRGQKHRLECPSCDSYEKKPPKEFLERFKSLLQKMIHQHLSSRTHGSEDS

SEQ ID NO: 1326 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSTNAGQRQKHRLTCPSCDSYEKKPPKEFLERFKSLLQKMIHQHLSSRTHGSEDS

SEQ ID NO: 1327 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRGQKHTLTCPSCDSYEKKPPKEFLERFKSLLQKMIHQHLSSRTHGSEDS

SEQ ID NO: 1328 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 1329 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKVPSTNAGQRQKHRLTCPSCDSYEKKPPKEFLERFKSLLQKMIHQHLSSRTHGSEDS

SEQ ID NO: 1330 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGGGQKHRLTCPSCDSYEKKPPKEFLERFKSLLQKMIHQHLSSRTHGSEDS

SEQ ID NO: 1331 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGRGQKHRLECPSCDSYEKKPPKEFLERFKSLLQKMIHQHLSSRTHGSEDS

SEQ ID NO: 1332 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGGDQKHRLECPSCDSYEKKPPKEFLERFKSLLQKMIHQHLSSRTHGSEDS

SEQ ID NO: 1333 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNPGRGQKHRLTCPSCDSYEKKPPKEFLERFKSLLQKMIHQHLSSRTHGSEDS

SEQ ID NO: 1334 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNPGQRQKHRLTCPSCDSYEKKPPKEFLERFKSLLQKMIHQHLSSRTHGSEDS

SEQ ID NO: 1335 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNPGQDQKHRLTCPSCDSYEKKPPKEFLERFKSLLQKMIHQHLSSRTHGSEDS

SEQ ID NO: 1336 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSDNAGRRQKHRLTCPSCDSYEKKPPKEFLERFKSLLQKMIHQHLSSRTHGSEDS

SEQ ID NO: 1337 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGGRQKHRLECPSCDSYEKKPPKEFLERFKSLLQKMIHQHLSSRTHGSEDS

SEQ ID NO: 1338 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQDAQLKSANTGNNERIINVSIKKLKRKPPSTNAGRGQKHRLTCPSCDSYEKKPPKEFLERFKSLLQKMIHQHLSSRTHGSEDS

SEQ ID NO: 1339 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSTNAGQGQKHRLTCPSCDSYEKKPPKEFLERFKSLLQKMIHQHLSSRTHGSEDS

SEQ ID NO: 1340 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGRGQKHRLECPSCDSYEKKPPKEFLERFKSLLQKMIHQHLSSRTHGSEDS

SEQ ID NO: 1341 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGGGQKHRLTCPSCDSYEKKPPKEFLERFKSLLQKMIHQHLSSRTHGSEDS

SEQ ID NO: 1342 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNPGGRQKHRLTCPSCDSYEKKPPKEFLERFKSLLQKMIHQHLSSRTHGSEDS

SEQ ID NO: 1343 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQDAQLKSANTGNNERIINVSIKKLKRKPPSTNAGQRQKHRLTCPSCDSYEKKPPKEFLERFKSLLQKMIHQHLSSRTHGSEDS

SEQ ID NO: 1344 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGQRQKDRLECPSCDSYEKKPPKEFLERFKSLLQKMIHQHLSSRTHGSEDS

SEQ ID NO: 1345 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSDNAGGGQKHRLTCPSCDSYEKKPPKEFLERFKSLLQKMIHQHLSSRTHGSEDS

SEQ ID NO: 1346 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGQDQKDRLTCPSCDSYEKKPPKEFLERFKSLLQKMIHQHLSSRTHGSEDS

SEQ ID NO: 1347 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRRQKDTLTCPSCDSYEKKPPKEFLERFKSLLQKMIHQHLSSRTHGSEDS

SEQ ID NO: 1348 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSTNAGGRQKHRLTCPSCDSYEKKPPKEFLERFKSLLQKMIHQHLSSRTHGSEDS

SEQ ID NO: 1349 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGGDQKHRLTCPSCDSYEKKPPKEFLERFKSLLQKMIHQHLSSRTHGSEDS

SEQ ID NO: 1350 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGRGQKHRLTCPSCDSYEKKPPKEFLERFKSLLQKMIHQHLSSRTHGSEDS

SEQ ID NO: 1351 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSTNAGGRQKHRLTCPSCDSYEKKPPKEFLERFKSLLQKMIHQHLSSRTHGSEDS

SEQ ID NO: 1352 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNPGQRQKHRLTCPSCDSYEKKPPKEFLERFKSLLQKMIHQHLSSRTHGSEDS

SEQ ID NO: 1353 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSTNPGGRQKHRLTCPSCDSYEKKPPKEFLERFKSLLQKMIHQHLSSRTHGSEDS

SEQ ID NO: 1354 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKVPSTNAGRRQKDRLTCPSCDSYEKKPPKEFLERFKSLLQKMIHQHLSSRTHGSEDS

SEQ ID NO: 1355 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINESIKKLKRKPPSTNAGRDQKHRLTCPSCDSYEKKPPKEFLERFKSLLQKMIHQHLSSRTHGSEDS

SEQ ID NO: 1356 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRRQKDRLECPSCDSYEKKPPKEFLERFKSLLQKMIHQHLSSRTHGSEDS

SEQ ID NO: 1357 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRDQKDRLECPSCDSYEKKPPKEFLERFKSLLQKMIHQHLSSRTHGSEDS

SEQ ID NO: 1358 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGGRQKHRLTCPSCDSYEKKPPKEFLERFKSLLQKMIHQHLSSRTHGSEDS

SEQ ID NO: 1359 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSDNAGRRQKHRLECPSCDSYEKKPPKEFLERFKSLLQKMIHQHLSSRTHGSEDS

SEQ ID NO: 1360 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNPGGRQKHRLTCPSCDSYEKKPPKEFLERFKSLLQKMIHQHLSSRTHGSEDS

SEQ ID NO: 1361 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRDQKDRLECPSCDSYEKKPPKEFLERFKSLLQKMIHQHLSSRTHGSEDS

SEQ ID NO: 1362 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGQRQKHRLECPSCDSYEKKPPKEFLERFKSLLQKMIHQHLSSRTHGSEDS

SEQ ID NO: 1363 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGRDQKHRLTCPSCDSYEKKPPKEFLERFKSLLQKMIHQHLSSRTHGSEDS

SEQ ID NO: 1364 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKVPSDNAGRRQKHRLTCPSCDSYEKKPPKEFLERFKSLLQKMIHQHLSSRTHGSEDS

SEQ ID NO: 1365 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGRGQKHTLTCPSCDSYEKKPPKEFLERFKSLLQKMIHQHLSSRTHGSEDS

SEQ ID NO: 1366 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSDNAGGRQKHRLTCPSCDSYEKKPPKEFLERFKSLLQKMIHQHLSSRTHGSEDS

SEQ ID NO: 1367 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKVPSTNAGGRQKHRLTCPSCDSYEKKPPKEFLERFKSLLQKMIHQHLSSRTHGSEDS

SEQ ID NO: 1368 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNPGQRQKHRLTCPSCDSYEKKPPKEFLERFKSLLQKMIHQHLSSRTHGSEDS

SEQ ID NO: 1369 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKVPSTNAGQRQKHRLTCPSCDSYEKKPPKEFLERFKSLLQKMIHQHLSSRTHGSEDS

SEQ ID NO: 1370 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 1371 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGRRQKHTLECPSCDSYEKKPPKEFLERFKSLLQKMIHQHLSSRTHGSEDS

SEQ ID NO: 1372 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRDQKDTLTCPSCDSYEKKPPKEFLERFKSLLQKMIHQHLSSRTHGSEDS

SEQ ID NO: 1373 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGRGQKHRLECPSCDSYEKKPPKEFLERFKSLLQKMIHQHLSSRTHGSEDS

SEQ ID NO: 1374 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRDQKDTLTCPSCDSYEKKPPKEFLERFKSLLQKMIHQHLSSRTHGSEDS

SEQ ID NO: 1375 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSTNAGQRQKHRLTCPSCDSYEKKPPKEFLERFKSLLQKMIHQHLSSRTHGSEDS

SEQ ID NO: 1376 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSDNPGRRQKHRLTCPSCDSYEKKPPKEFLERFKSLLQKMIHQHLSSRTHGSEDS

SEQ ID NO: 1377 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSDNAGRRQKHRLTCPSCDSYEKKPPKEFLERFKSLLQKMIHQHLSSRTHGSEDS

SEQ ID NO: 1378 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGGRQKHTLTCPSCDSYEKKPPKEFLERFKSLLQKMIHQHLSSRTHGSEDS

SEQ ID NO: 1379 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKVPSTNAGRRQKHTLTCPSCDSYEKKPPKEFLERFKSLLQKMIHQHLSSRTHGSEDS

SEQ ID NO: 1380 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSDNAGQDQKHRLTCPSCDSYEKKPPKEFLERFKSLLQKMIHQHLSSRTHGSEDS

SEQ ID NO: 1381 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRGQKDRLECPSCDSYEKKPPKEFLERFKSLLQKMIHQHLSSRTHGSEDS

SEQ ID NO: 1382 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSTNAGGGQKHRLTCPSCDSYEKKPPKEFLERFKSLLQKMIHQHLSSRTHGSEDS

SEQ ID NO: 1383 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKRKPPSTNAGRGQKHRLTCPSCDSYEKKPPKEFLERFKSLLQKMIHQHLSSRTHGSEDS

SEQ ID NO: 1384 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 1385 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKVPSTNAGRGQKHRLTCPSCDSYEKKPPKEFLERFKSLLQKMIHQHLSSRTHGSEDS

SEQ ID NO: 1386 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGQRQKHRLTCPSCDSYEKKPPKEFLERFKSLLQKMIHQHLSSRTHGSEDS

SEQ ID NO: 1387 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGQDQKDRLTCPSCDSYEKKPPKEFLERFKSLLQKMIHQHLSSRTHGSEDS

SEQ ID NO: 1388 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRRQKDTLTCPSCDSYEKKPPKEFLERFKSLLQKMIHQHLSSRTHGSEDS

SEQ ID NO: 1389 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGRRQKDRLTCPSCDSYEKKPPKEFLERFKSLLQKMIHQHLSSRTHGSEDS

SEQ ID NO: 1390 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSDNAGRRQKHRLTCPSCDSYEKKPPKEFLERFKSLLQKMIHQHLSSRTHGSEDS

SEQ ID NO: 1391 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGGRQKHRLECPSCDSYEKKPPKEFLERFKSLLQKMIHQHLSSRTHGSEDS

SEQ ID NO: 1392 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGRRQKDRLTCPSCDSYEKKPPKEFLERFKSLLQKMIHQHLSSRTHGSEDS

SEQ ID NO: 1393 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQDAQLKSANTGNNERIINVSIKKLKRKPPSTNAGGRQKHRLTCPSCDSYEKKPPKEFLERFKSLLQKMIHQHLSSRTHGSEDS

SEQ ID NO: 1394 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGQRQKHTLTCPSCDSYEKKPPKEFLERFKSLLQKMIHQHLSSRTHGSEDS

SEQ ID NO: 1395 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKVPSTNAGRDQKHRLTCPSCDSYEKKPPKEFLERFKSLLQKMIHQHLSSRTHGSEDS

SEQ ID NO: 1396 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKVPSTNAGRGQKHRLTCPSCDSYEKKPPKEFLERFKSLLQKMIHQHLSSRTHGSEDS

SEQ ID NO: 1397 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGRGQKHRLTCPSCDSYEKKPPKEFLERFKSLLQKMIHQHLSSRTHGSEDS

SEQ ID NO: 1398 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGGDQKHRLTCPSCDSYEKKPPKEFLERFKSLLQKMIHQHLSSRTHGSEDS

SEQ ID NO: 1399 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGRRQKHRLECPSCDSYEKKPPKEFLERFKSLLQKMIHQHLSSRTHGSEDS

SEQ ID NO: 1400 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGRDQKHTLTCPSCDSYEKKPPKEFLERFKSLLQKMIHQHLSSRTHGSEDS

SEQ ID NO: 1401 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRGQKDRLTCPSCDSYEKKPPKEFLERFKSLLQKMIHQHLSSRTHGSEDS

SEQ ID NO: 1402 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSDNAGQRQKHRLTCPSCDSYEKKPPKEFLERFKSLLQKMIHQHLSSRTHGSEDS

SEQ ID NO: 1403 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGRGQKDRLTCPSCDSYEKKPPKEFLERFKSLLQKMIHQHLSSRTHGSEDS

SEQ ID NO: 1404 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGQRQKDRLTCPSCDSYEKKPPKEFLERFKSLLQKMIHQHLSSRTHGSEDS

SEQ ID NO: 1405 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGGRQKHTLTCPSCDSYEKKPPKEFLERFKSLLQKMIHQHLSSRTHGSEDS

SEQ ID NO: 1406 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKVPSTNAGGRQKHRLTCPSCDSYEKKPPKEFLERFKSLLQKMIHQHLSSRTHGSEDS

SEQ ID NO: 1407 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGQDQKHTLTCPSCDSYEKKPPKEFLERFKSLLQKMIHQHLSSRTHGSEDS

SEQ ID NO: 1408 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGRDQKHRLTCPSCDSYEKKPPKEFLERFKSLLQKMIHQHLSSRTHGSEDS

SEQ ID NO: 1409 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNPGGRQKHRLTCPSCDSYEKKPPKEFLERFKSLLQKMIHQHLSSRTHGSEDS

SEQ ID NO: 1410 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 1411 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGRGQKHRLTCPSCDSYEKKPPKEFLERFKSLLQKMIHQHLSSRTHGSEDS

SEQ ID NO: 1412 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSDNAGRRQKHTLTCPSCDSYEKKPPKEFLERFKSLLQKMIHQHLSSRTHGSEDS

SEQ ID NO: 1413 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNPGRRQKDRLTCPSCDSYEKKPPKEFLERFKSLLQKMIHQHLSSRTHGSEDS

SEQ ID NO: 1414 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKVPSDNAGRRQKHRLTCPSCDSYEKKPPKEFLERFKSLLQKMIHQHLSSRTHGSEDS

SEQ ID NO: 1415 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKVPSTNAGQRQKHRLTCPSCDSYEKKPPKEFLERFKSLLQKMIHQHLSSRTHGSEDS

SEQ ID NO: 1416 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGRDQKHRLTCPSCDSYEKKPPKEFLERFKSLLQKMIHQHLSSRTHGSEDS

SEQ ID NO: 1417 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKVPSDNAGRRQKHRLTCPSCDSYEKKPPKEFLERFKSLLQKMIHQHLSSRTHGSEDS

SEQ ID NO: 1418 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKVPSTNAGGRQKHRLTCPSCDSYEKKPPKEFLERFKSLLQKMIHQHLSSRTHGSEDS

SEQ ID NO: 1419 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGGGQKHRLECPSCDSYEKKPPKEFLERFKSLLQKMIHQHLSSRTHGSEDS

SEQ ID NO: 1420 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSTNAGRDQKHRLTCPSCDSYEKKPPKEFLERFKSLLQKMIHQHLSSRTHGSEDS

SEQ ID NO: 1421 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGGRQKDRLTCPSCDSYEKKPPKEFLERFKSLLQKMIHQHLSSRTHGSEDS

SEQ ID NO: 1422 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGGRQKHTLTCPSCDSYEKKPPKEFLERFKSLLQKMIHQHLSSRTHGSEDS

SEQ ID NO: 1423 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNPGQRQKHRLTCPSCDSYEKKPPKEFLERFKSLLQKMIHQHLSSRTHGSEDS

SEQ ID NO: 1424 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGRRQKDRLTCPSCDSYEKKPPKEFLERFKSLLQKMIHQHLSSRTHGSEDS

SEQ ID NO: 1425 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSTNAGRGQKHRLTCPSCDSYEKKPPKEFLERFKSLLQKMIHQHLSSRTHGSEDS

SEQ ID NO: 1426 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRRQKDRLECPSCDSYEKKPPKEFLERFKSLLQKMIHQHLSSRTHGSEDS

SEQ ID NO: 1427 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSDNPGRRQKHRLTCPSCDSYEKKPPKEFLERFKSLLQKMIHQHLSSRTHGSEDS

SEQ ID NO: 1428 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGQRQKHTLTCPSCDSYEKKPPKEFLERFKSLLQKMIHQHLSSRTHGSEDS

SEQ ID NO: 1429 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGQGQKDRLTCPSCDSYEKKPPKEFLERFKSLLQKMIHQHLSSRTHGSEDS

SEQ ID NO: 1430 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQDAQLKSANTGNNERIINVSIKKLKRKPPSDNAGRRQKHRLTCPSCDSYEKKPPKEFLERFKSLLQKMIHQHLSSRTHGSEDS

SEQ ID NO: 1431 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNPGGRQKHRLTCPSCDSYEKKPPKEFLERFKSLLQKMIHQHLSSRTHGSEDS

SEQ ID NO: 1432 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGRGQKDRLTCPSCDSYEKKPPKEFLERFKSLLQKMIHQHLSSRTHGSEDS

SEQ ID NO: 1433 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQDQKDTLTCPSCDSYEKKPPKEFLERFKSLLQKMIHQHLSSRTHGSEDS

SEQ ID NO: 1434 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSTNAGGDQKHRLTCPSCDSYEKKPPKEFLERFKSLLQKMIHQHLSSRTHGSEDS

SEQ ID NO: 1435 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRGQKHRLTCPSCDSYEKKPPKEFLERFKSLLQKMIHQHLSSRTHGSEDS

SEQ ID NO: 1436 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRGQKHRLECPSCDSYEKKPPKEFLERFKSLLQKMIHQHLSSRTHGSEDS

SEQ ID NO: 1437 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNPGGRQKHRLTCPSCDSYEKKPPKEFLERFKSLLQKMIHQHLSSRTHGSEDS

SEQ ID NO: 1438 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINESIKKLKRKPPSDNAGRRQKHRLTCPSCDSYEKKPPKEFLERFKSLLQKMIHQHLSSRTHGSEDS

SEQ ID NO: 1439 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRDQKDTLECPSCDSYEKKPPKEFLERFKSLLQKMIHQHLSSRTHGSEDS

SEQ ID NO: 1440 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKRKPPSTNAGQRQKHRLTCPSCDSYEKKPPKEFLERFKSLLQKMIHQHLSSRTHGSEDS

SEQ ID NO: 1441 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKVPSTNAGRRQKHRLTCPSCDSYEKKPPKEFLERFKSLLQKMIHQHLSSRTHGSEDS

SEQ ID NO: 1442 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGQGQKHTLTCPSCDSYEKKPPKEFLERFKSLLQKMIHQHLSSRTHGSEDS

SEQ ID NO: 1443 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKVPSTNAGGRQKHRLTCPSCDSYEKKPPKEFLERFKSLLQKMIHQHLSSRTHGSEDS

SEQ ID NO: 1444 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSTNAGGDQKHRLTCPSCDSYEKKPPKEFLERFKSLLQKMIHQHLSSRTHGSEDS

SEQ ID NO: 1445 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNPGRRQKDRLTCPSCDSYEKKPPKEFLERFKSLLQKMIHQHLSSRTHGSEDS

SEQ ID NO: 1446 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKVPSTNAGGRQKHRLTCPSCDSYEKKPPKEFLERFKSLLQKMIHQHLSSRTHGSEDS

SEQ ID NO: 1447 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGQRQKHTLTCPSCDSYEKKPPKEFLERFKSLLQKMIHQHLSSRTHGSEDS

SEQ ID NO: 1448 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGRRQKHTLTCPSCDSYEKKPPKEFLERFKSLLQKMIHQHLSSRTHGSEDS

SEQ ID NO: 1449 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRDQKDTLTCPSCDSYEKKPPKEFLERFKSLLQKMIHQHLSSRTHGSEDS

SEQ ID NO: 1450 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSTNAGRGQKHRLTCPSCDSYEKKPPKEFLERFKSLLQKMIHQHLSSRTHGSEDS

SEQ ID NO: 1451 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGRGQKHRLTCPSCDSYEKKPPKEFLERFKSLLQKMIHQHLSSRTHGSEDS

SEQ ID NO: 1452 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSDNAGRRQKHRLTCPSCDSYEKKPPKEFLERFKSLLQKMIHQHLSSRTHGSEDS

SEQ ID NO: 1453 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGGRQKHRLTCPSCDSYEKKPPKEFLERFKSLLQKMIHQHLSSRTHGSEDS

SEQ ID NO: 1454 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGQRQKHRLECPSCDSYEKKPPKEFLERFKSLLQKMIHQHLSSRTHGSEDS

SEQ ID NO: 1455 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGQRQKHRLTCPSCDSYEKKPPKEFLERFKSLLQKMIHQHLSSRTHGSEDS

SEQ ID NO: 1456 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGQDQKHRLTCPSCDSYEKKPPKEFLERFKSLLQKMIHQHLSSRTHGSEDS

SEQ ID NO: 1457 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGRRQKHTLECPSCDSYEKKPPKEFLERFKSLLQKMIHQHLSSRTHGSEDS

SEQ ID NO: 1458 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKPPSTNPGRRQKHRLTCPSCDSYEKKPPKEFLERFKSLLQKMIHQHLSSRTHGSEDS

SEQ ID NO: 1459 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRGQKDTLTCPSCDSYEKKPPKEFLERFKSLLQKMIHQHLSSRTHGSEDS

SEQ ID NO: 1460 - protein, 162 aa, synthetic construct
MRSSPGNMERIVICLMVIFLGTLVHKSSSQGQDRIMIRMRQLIDTVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 1461 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRDQKHTLECPSCDSYEKKPPKEFLERFKSLLQKMIHQHLSSRTHGSEDS

SEQ ID NO: 1462 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 1463 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSTNAGQGQKHRLTCPSCDSYEKKPPKEFLERFKSLLQKMIHQHLSSRTHGSEDS

SEQ ID NO: 1464 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGRRQKHRLTCPSCDSYEKKPPKEFLERFKSLLQKMIHQHLSSRTHGSEDS

SEQ ID NO: 1465 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGQRQKHTLTCPSCDSYEKKPPKEFLERFKSLLQKMIHQHLSSRTHGSEDS

SEQ ID NO: 1466 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSTNAGGDQKHRLTCPSCDSYEKKPPKEFLERFKSLLQKMIHQHLSSRTHGSEDS

SEQ ID NO: 1467 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGGDQKHTLTCPSCDSYEKKPPKEFLERFKSLLQKMIHQHLSSRTHGSEDS

SEQ ID NO: 1468 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSDNAGRDQKHRLTCPSCDSYEKKPPKEFLERFKSLLQKMIHQHLSSRTHGSEDS

SEQ ID NO: 1469 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGGDQKHTLTCPSCDSYEKKPPKEFLERFKSLLQKMIHQHLSSRTHGSEDS

SEQ ID NO: 1470 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSDNPGRRQKHRLTCPSCDSYEKKPPKEFLERFKSLLQKMIHQHLSSRTHGSEDS

SEQ ID NO: 1471 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNPGQRQKHRLTCPSCDSYEKKPPKEFLERFKSLLQKMIHQHLSSRTHGSEDS

SEQ ID NO: 1472 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGRRQKHTLTCPSCDSYEKKPPKEFLERFKSLLQKMIHQHLSSRTHGSEDS

SEQ ID NO: 1473 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGQRQKDRLTCPSCDSYEKKPPKEFLERFKSLLQKMIHQHLSSRTHGSEDS

SEQ ID NO: 1474 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSTNPGRDQKHRLTCPSCDSYEKKPPKEFLERFKSLLQKMIHQHLSSRTHGSEDS

SEQ ID NO: 1475 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNPGRRQKHTLTCPSCDSYEKKPPKEFLERFKSLLQKMIHQHLSSRTHGSEDS

SEQ ID NO: 1476 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGQRQKHRLTCPSCDSYEKKPPKEFLERFKSLLQKMIHQHLSSRTHGSEDS

SEQ ID NO: 1477 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGRDQKHTLTCPSCDSYEKKPPKEFLERFKSLLQKMIHQHLSSRTHGSEDS

SEQ ID NO: 1478 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSDNAGQRQKHRLTCPSCDSYEKKPPKEFLERFKSLLQKMIHQHLSSRTHGSEDS

SEQ ID NO: 1479 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGRRQKDRLTCPSCDSYEKKPPKEFLERFKSLLQKMIHQHLSSRTHGSEDS

SEQ ID NO: 1480 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKVPSTNAGRGQKHRLTCPSCDSYEKKPPKEFLERFKSLLQKMIHQHLSSRTHGSEDS

SEQ ID NO: 1481 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSTNAGRDQKHRLTCPSCDSYEKKPPKEFLERFKSLLQKMIHQHLSSRTHGSEDS

SEQ ID NO: 1482 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGRRQKDRLTCPSCDSYEKKPPKEFLERFKSLLQKMIHQHLSSRTHGSEDS

SEQ ID NO: 1483 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSDNAGRDQKHRLTCPSCDSYEKKPPKEFLERFKSLLQKMIHQHLSSRTHGSEDS

SEQ ID NO: 1484 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGQRQKHRLECPSCDSYEKKPPKEFLERFKSLLQKMIHQHLSSRTHGSEDS

SEQ ID NO: 1485 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSDNAGQGQKHRLTCPSCDSYEKKPPKEFLERFKSLLQKMIHQHLSSRTHGSEDS

SEQ ID NO: 1486 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNPGRGQKHRLTCPSCDSYEKKPPKEFLERFKSLLQKMIHQHLSSRTHGSEDS

SEQ ID NO: 1487 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSTNAGQDQKHRLTCPSCDSYEKKPPKEFLERFKSLLQKMIHQHLSSRTHGSEDS

SEQ ID NO: 1488 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKVPSTNPGRRQKHRLTCPSCDSYEKKPPKEFLERFKSLLQKMIHQHLSSRTHGSEDS

SEQ ID NO: 1489 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSDNAGQDQKHRLTCPSCDSYEKKPPKEFLERFKSLLQKMIHQHLSSRTHGSEDS

SEQ ID NO: 1490 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRRQKDRLTCPSCDSYEKKPPKEFLERFKSLLQKMIHQHLSSRTHGSEDS

SEQ ID NO: 1491 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRGQKDTLTCPSCDSYEKKPPKEFLERFKSLLQKMIHQHLSSRTHGSEDS

SEQ ID NO: 1492 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRGQKHRLECPSCDSYEKKPPKEFLERFKSLLQKMIHQHLSSRTHGSEDS

SEQ ID NO: 1493 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGQRQKHRLECPSCDSYEKKPPKEFLERFKSLLQKMIHQHLSSRTHGSEDS

SEQ ID NO: 1494 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGRRQKHTLTCPSCDSYEKKPPKEFLERFKSLLQKMIHQHLSSRTHGSEDS

SEQ ID NO: 1495 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQDAQLKSANTGNNERIINVSIKKLKRKPPSDNAGRRQKHRLTCPSCDSYEKKPPKEFLERFKSLLQKMIHQHLSSRTHGSEDS

SEQ ID NO: 1496 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNPGRRQKHRLECPSCDSYEKKPPKEFLERFKSLLQKMIHQHLSSRTHGSEDS

SEQ ID NO: 1497 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGRGQKDRLTCPSCDSYEKKPPKEFLERFKSLLQKMIHQHLSSRTHGSEDS

SEQ ID NO: 1498 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGGDQKDRLTCPSCDSYEKKPPKEFLERFKSLLQKMIHQHLSSRTHGSEDS

SEQ ID NO: 1499 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGRDQKDRLTCPSCDSYEKKPPKEFLERFKSLLQKMIHQHLSSRTHGSEDS

SEQ ID NO: 1500 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSDNAGRDQKHRLTCPSCDSYEKKPPKEFLERFKSLLQKMIHQHLSSRTHGSEDS

SEQ ID NO: 1501 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGQRQKHRLTCPSCDSYEKKPPKEFLERFKSLLQKMIHQHLSSRTHGSEDS

SEQ ID NO: 1502 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINESIKKLKRKVPSTNAGRRQKHRLTCPSCDSYEKKPPKEFLERFKSLLQKMIHQHLSSRTHGSEDS

SEQ ID NO: 1503 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSDNAGGRQKHRLTCPSCDSYEKKPPKEFLERFKSLLQKMIHQHLSSRTHGSEDS

SEQ ID NO: 1504 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGGDQKHRLECPSCDSYEKKPPKEFLERFKSLLQKMIHQHLSSRTHGSEDS

SEQ ID NO: 1505 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGGRQKHRLECPSCDSYEKKPPKEFLERFKSLLQKMIHQHLSSRTHGSEDS

SEQ ID NO: 1506 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGRDQKHTLTCPSCDSYEKKPPKEFLERFKSLLQKMIHQHLSSRTHGSEDS

SEQ ID NO: 1507 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQDAQLKSANTGNNERIINVSIKKLKRKPPSTNAGRDQKHRLTCPSCDSYEKKPPKEFLERFKSLLQKMIHQHLSSRTHGSEDS

SEQ ID NO: 1508 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGQRQKHRLECPSCDSYEKKPPKEFLERFKSLLQKMIHQHLSSRTHGSEDS

SEQ ID NO: 1509 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINESIKKLKRKPPSTNAGQRQKHRLTCPSCDSYEKKPPKEFLERFKSLLQKMIHQHLSSRTHGSEDS

SEQ ID NO: 1510 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 1511 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGRDQKDRLTCPSCDSYEKKPPKEFLERFKSLLQKMIHQHLSSRTHGSEDS

SEQ ID NO: 1512 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNPGRRQKHRLTCPSCDSYEKKPPKEFLERFKSLLQKMIHQHLSSRTHGSEDS

SEQ ID NO: 1513 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINESIKKLKRKPPSTNAGGRQKHRLTCPSCDSYEKKPPKEFLERFKSLLQKMIHQHLSSRTHGSEDS

SEQ ID NO: 1514 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGRRQKHTLTCPSCDSYEKKPPKEFLERFKSLLQKMIHQHLSSRTHGSEDS

SEQ ID NO: 1515 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGQDQKDRLTCPSCDSYEKKPPKEFLERFKSLLQKMIHQHLSSRTHGSEDS

SEQ ID NO: 1516 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGGDQKHRLECPSCDSYEKKPPKEFLERFKSLLQKMIHQHLSSRTHGSEDS

SEQ ID NO: 1517 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSTNPGQRQKHRLTCPSCDSYEKKPPKEFLERFKSLLQKMIHQHLSSRTHGSEDS

SEQ ID NO: 1518 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGRGQKDRLTCPSCDSYEKKPPKEFLERFKSLLQKMIHQHLSSRTHGSEDS

SEQ ID NO: 1519 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQDAQLKSANTGNNERIINVSIKKLKRKVPSTNAGRRQKHRLTCPSCDSYEKKPPKEFLERFKSLLQKMIHQHLSSRTHGSEDS

SEQ ID NO: 1520 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGGRQKHRLECPSCDSYEKKPPKEFLERFKSLLQKMIHQHLSSRTHGSEDS

SEQ ID NO: 1521 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSTNAGGDQKHRLTCPSCDSYEKKPPKEFLERFKSLLQKMIHQHLSSRTHGSEDS

SEQ ID NO: 1522 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGRRQKHTLECPSCDSYEKKPPKEFLERFKSLLQKMIHQHLSSRTHGSEDS

SEQ ID NO: 1523 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGQDQKHRLECPSCDSYEKKPPKEFLERFKSLLQKMIHQHLSSRTHGSEDS

SEQ ID NO: 1524 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNPGRGQKHRLTCPSCDSYEKKPPKEFLERFKSLLQKMIHQHLSSRTHGSEDS

SEQ ID NO: 1525 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGRRQKDRLTCPSCDSYEKKPPKEFLERFKSLLQKMIHQHLSSRTHGSEDS

SEQ ID NO: 1526 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGDQKDRLECPSCDSYEKKPPKEFLERFKSLLQKMIHQHLSSRTHGSEDS

SEQ ID NO: 1527 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGGRQKHRLTCPSCDSYEKKPPKEFLERFKSLLQKMIHQHLSSRTHGSEDS

SEQ ID NO: 1528 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSDNAGRRQKHRLTCPSCDSYEKKPPKEFLERFKSLLQKMIHQHLSSRTHGSEDS

SEQ ID NO: 1529 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNPGRRQKHRLECPSCDSYEKKPPKEFLERFKSLLQKMIHQHLSSRTHGSEDS

SEQ ID NO: 1530 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGRRQKDTLTCPSCDSYEKKPPKEFLERFKSLLQKMIHQHLSSRTHGSEDS

SEQ ID NO: 1531 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGGDQKDRLTCPSCDSYEKKPPKEFLERFKSLLQKMIHQHLSSRTHGSEDS

SEQ ID NO: 1532 - protein, 162 aa, synthetic construct
MRSSPGNMERIVICLMVIFLGTLVHKSSSQGQDRFMIRMRQLIDTVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 1533 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSTNAGQGQKHRLTCPSCDSYEKKPPKEFLERFKSLLQKMIHQHLSSRTHGSEDS

SEQ ID NO: 1534 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQDAQLKSANTGNNERIINVSIKKLKRKPPSTNPGRRQKHRLTCPSCDSYEKKPPKEFLERFKSLLQKMIHQHLSSRTHGSEDS

SEQ ID NO: 1535 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGQGQKHRLTCPSCDSYEKKPPKEFLERFKSLLQKMIHQHLSSRTHGSEDS

SEQ ID NO: 1536 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGGRQKHRLTCPSCDSYEKKPPKEFLERFKSLLQKMIHQHLSSRTHGSEDS

SEQ ID NO: 1537 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQDAQLKSANTGNNERIINVSIKKLKRKPPSTNAGRGQKHRLTCPSCDSYEKKPPKEFLERFKSLLQKMIHQHLSSRTHGSEDS

SEQ ID NO: 1538 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNPGGRQKHRLTCPSCDSYEKKPPKEFLERFKSLLQKMIHQHLSSRTHGSEDS

SEQ ID NO: 1539 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQDAQLKSANTGNNERIINVSIKKLKRKPPSTNPGRRQKHRLTCPSCDSYEKKPPKEFLERFKSLLQKMIHQHLSSRTHGSEDS

SEQ ID NO: 1540 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQDAQLKSANTGNNERIINVSIKKLKRKPPSTNAGQRQKHRLTCPSCDSYEKKPPKEFLERFKSLLQKMIHQHLSSRTHGSEDS

SEQ ID NO: 1541 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKVPSTNAGRRQKHRLTCPSCDSYEKKPPKEFLERFKSLLQKMIHQHLSSRTHGSEDS

SEQ ID NO: 1542 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGQRQKHTLECPSCDSYEKKPPKEFLERFKSLLQKMIHQHLSSRTHGSEDS

SEQ ID NO: 1543 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSTNAGQDQKHRLTCPSCDSYEKKPPKEFLERFKSLLQKMIHQHLSSRTHGSEDS

SEQ ID NO: 1544 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNPGRRQKHRLECPSCDSYEKKPPKEFLERFKSLLQKMIHQHLSSRTHGSEDS

SEQ ID NO: 1545 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNPGRRQKHTLTCPSCDSYEKKPPKEFLERFKSLLQKMIHQHLSSRTHGSEDS

SEQ ID NO: 1546 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGQRQKHRLTCPSCDSYEKKPPKEFLERFKSLLQKMIHQHLSSRTHGSEDS

SEQ ID NO: 1547 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQDQKDRLECPSCDSYEKKPPKEFLERFKSLLQKMIHQHLSSRTHGSEDS

SEQ ID NO: 1548 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNPGRRQKHRLTCPSCDSYEKKPPKEFLERFKSLLQKMIHQHLSSRTHGSEDS

SEQ ID NO: 1549 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGGRQKHRLECPSCDSYEKKPPKEFLERFKSLLQKMIHQHLSSRTHGSEDS

SEQ ID NO: 1550 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGGDQKHRLECPSCDSYEKKPPKEFLERFKSLLQKMIHQHLSSRTHGSEDS

SEQ ID NO: 1551 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKVPSTNAGRRQKHTLTCPSCDSYEKKPPKEFLERFKSLLQKMIHQHLSSRTHGSEDS

SEQ ID NO: 1552 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRDQKDRLTCPSCDSYEKKPPKEFLERFKSLLQKMIHQHLSSRTHGSEDS

SEQ ID NO: 1553 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKVPSTNAGRRQKHRLECPSCDSYEKKPPKEFLERFKSLLQKMIHQHLSSRTHGSEDS

SEQ ID NO: 1554 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGGDQKHRLTCPSCDSYEKKPPKEFLERFKSLLQKMIHQHLSSRTHGSEDS

SEQ ID NO: 1555 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSDNAGRGQKHRLTCPSCDSYEKKPPKEFLERFKSLLQKMIHQHLSSRTHGSEDS

SEQ ID NO: 1556 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQDAQLKSANTGNNERIINVSIKKLKRKPPSTNAGGRQKHRLTCPSCDSYEKKPPKEFLERFKSLLQKMIHQHLSSRTHGSEDS

SEQ ID NO: 1557 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGGRQKHRLTCPSCDSYEKKPPKEFLERFKSLLQKMIHQHLSSRTHGSEDS

SEQ ID NO: 1558 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGQDQKHRLTCPSCDSYEKKPPKEFLERFKSLLQKMIHQHLSSRTHGSEDS

SEQ ID NO: 1559 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQDAQLKSANTGNNERIINVSIKKLKRKPPSTNAGGRQKHRLTCPSCDSYEKKPPKEFLERFKSLLQKMIHQHLSSRTHGSEDS

SEQ ID NO: 1560 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGGRQKDTLTCPSCDSYEKKPPKEFLERFKSLLQKMIHQHLSSRTHGSEDS

SEQ ID NO: 1561 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSTNPGQRQKHRLTCPSCDSYEKKPPKEFLERFKSLLQKMIHQHLSSRTHGSEDS

SEQ ID NO: 1562 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQDAQLKSANTGNNERIINVSIKKLKRKPPSTNAGRGQKHRLTCPSCDSYEKKPPKEFLERFKSLLQKMIHQHLSSRTHGSEDS

SEQ ID NO: 1563 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKVPSTNPGRRQKHRLTCPSCDSYEKKPPKEFLERFKSLLQKMIHQHLSSRTHGSEDS

SEQ ID NO: 1564 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSDNPGRDQKHRLTCPSCDSYEKKPPKEFLERFKSLLQKMIHQHLSSRTHGSEDS

SEQ ID NO: 1565 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGQDQKHRLECPSCDSYEKKPPKEFLERFKSLLQKMIHQHLSSRTHGSEDS

SEQ ID NO: 1566 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINESIKKLKRKPPSTNAGQRQKHRLTCPSCDSYEKKPPKEFLERFKSLLQKMIHQHLSSRTHGSEDS

SEQ ID NO: 1567 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGQRQKHRLTCPSCDSYEKKPPKEFLERFKSLLQKMIHQHLSSRTHGSEDS

SEQ ID NO: 1568 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNPGGDQKHRLTCPSCDSYEKKPPKEFLERFKSLLQKMIHQHLSSRTHGSEDS

SEQ ID NO: 1569 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNPGRRQKHTLTCPSCDSYEKKPPKEFLERFKSLLQKMIHQHLSSRTHGSEDS

SEQ ID NO: 1570 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSDNAGRDQKHRLTCPSCDSYEKKPPKEFLERFKSLLQKMIHQHLSSRTHGSEDS

SEQ ID NO: 1571 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSTNAGGRQKHRLTCPSCDSYEKKPPKEFLERFKSLLQKMIHQHLSSRTHGSEDS

SEQ ID NO: 1572 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSDNAGGRQKHRLTCPSCDSYEKKPPKEFLERFKSLLQKMIHQHLSSRTHGSEDS

SEQ ID NO: 1573 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSDNAGGRQKHRLTCPSCDSYEKKPPKEFLERFKSLLQKMIHQHLSSRTHGSEDS

SEQ ID NO: 1574 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGRDQKHRLECPSCDSYEKKPPKEFLERFKSLLQKMIHQHLSSRTHGSEDS

SEQ ID NO: 1575 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGGGQKDRLTCPSCDSYEKKPPKEFLERFKSLLQKMIHQHLSSRTHGSEDS

SEQ ID NO: 1576 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNPGRRQKDRLTCPSCDSYEKKPPKEFLERFKSLLQKMIHQHLSSRTHGSEDS

SEQ ID NO: 1577 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSTNPGQRQKHRLTCPSCDSYEKKPPKEFLERFKSLLQKMIHQHLSSRTHGSEDS

SEQ ID NO: 1578 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSDNAGRGQKHRLTCPSCDSYEKKPPKEFLERFKSLLQKMIHQHLSSRTHGSEDS

SEQ ID NO: 1579 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSTNAGGDQKHRLTCPSCDSYEKKPPKEFLERFKSLLQKMIHQHLSSRTHGSEDS

SEQ ID NO: 1580 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKVPSTNAGQRQKHRLTCPSCDSYEKKPPKEFLERFKSLLQKMIHQHLSSRTHGSEDS

SEQ ID NO: 1581 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGQRQKHRLTCPSCDSYEKKPPKEFLERFKSLLQKMIHQHLSSRTHGSEDS

SEQ ID NO: 1582 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSDNAGQRQKHRLTCPSCDSYEKKPPKEFLERFKSLLQKMIHQHLSSRTHGSEDS

SEQ ID NO: 1583 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSTNPGRRQKHRLTCPSCDSYEKKPPKEFLERFKSLLQKMIHQHLSSRTHGSEDS

SEQ ID NO: 1584 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGRRQKHTLTCPSCDSYEKKPPKEFLERFKSLLQKMIHQHLSSRTHGSEDS

SEQ ID NO: 1585 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGRRQKHTLECPSCDSYEKKPPKEFLERFKSLLQKMIHQHLSSRTHGSEDS

SEQ ID NO: 1586 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSDNAGRGQKHRLTCPSCDSYEKKPPKEFLERFKSLLQKMIHQHLSSRTHGSEDS

SEQ ID NO: 1587 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSTNAGGGQKHRLTCPSCDSYEKKPPKEFLERFKSLLQKMIHQHLSSRTHGSEDS

SEQ ID NO: 1588 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNAGQDQKHRLTCPSCDSYEKKPPKEFLERFKSLLQKMIHQHLSSRTHGSEDS

SEQ ID NO: 1589 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSDNAGRRQKHRLECPSCDSYEKKPPKEFLERFKSLLQKMIHQHLSSRTHGSEDS

SEQ ID NO: 1590 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQDAQLKSANTGNNERIINVSIKKLKRKPPSDNAGRRQKHRLTCPSCDSYEKKPPKEFLERFKSLLQKMIHQHLSSRTHGSEDS

SEQ ID NO: 1591 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGGRQKDRLECPSCDSYEKKPPKEFLERFKSLLQKMIHQHLSSRTHGSEDS

SEQ ID NO: 1592 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGDQKDTLTCPSCDSYEKKPPKEFLERFKSLLQKMIHQHLSSRTHGSEDS

SEQ ID NO: 1593 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGRGQKHRLTCPSCDSYEKKPPKEFLERFKSLLQKMIHQHLSSRTHGSEDS

SEQ ID NO: 1594 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINESIKKLKRKPPSTNAGGRQKHRLTCPSCDSYEKKPPKEFLERFKSLLQKMIHQHLSSRTHGSEDS

SEQ ID NO: 1595 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNPGRRQKHTLTCPSCDSYEKKPPKEFLERFKSLLQKMIHQHLSSRTHGSEDS

SEQ ID NO: 1596 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGGRQKHRLECPSCDSYEKKPPKEFLERFKSLLQKMIHQHLSSRTHGSEDS

SEQ ID NO: 1597 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSTNAGQDQKHRLTCPSCDSYEKKPPKEFLERFKSLLQKMIHQHLSSRTHGSEDS

SEQ ID NO: 1598 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSTNPGRDQKHRLTCPSCDSYEKKPPKEFLERFKSLLQKMIHQHLSSRTHGSEDS

SEQ ID NO: 1599 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGGDQKHRLTCPSCDSYEKKPPKEFLERFKSLLQKMIHQHLSSRTHGSEDS

SEQ ID NO: 1600 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGQDQKHTLTCPSCDSYEKKPPKEFLERFKSLLQKMIHQHLSSRTHGSEDS

SEQ ID NO: 1601 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSDNAGRDQKHRLTCPSCDSYEKKPPKEFLERFKSLLQKMIHQHLSSRTHGSEDS

SEQ ID NO: 1602 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKVPSTNAGRDQKHRLTCPSCDSYEKKPPKEFLERFKSLLQKMIHQHLSSRTHGSEDS

SEQ ID NO: 1603 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKRKPPSTNPGRRQKHRLTCPSCDSYEKKPPKEFLERFKSLLQKMIHQHLSSRTHGSEDS

SEQ ID NO: 1604 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGRRQKDTLTCPSCDSYEKKPPKEFLERFKSLLQKMIHQHLSSRTHGSEDS

SEQ ID NO: 1605 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSDNPGRRQKHRLTCPSCDSYEKKPPKEFLERFKSLLQKMIHQHLSSRTHGSEDS

SEQ ID NO: 1606 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGGGQKHRLTCPSCDSYEKKPPKEFLERFKSLLQKMIHQHLSSRTHGSEDS

SEQ ID NO: 1607 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSDNAGQRQKHRLTCPSCDSYEKKPPKEFLERFKSLLQKMIHQHLSSRTHGSEDS

SEQ ID NO: 1608 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGGDQKHRLTCPSCDSYEKKPPKEFLERFKSLLQKMIHQHLSSRTHGSEDS

SEQ ID NO: 1609 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSTNAGQGQKHRLTCPSCDSYEKKPPKEFLERFKSLLQKMIHQHLSSRTHGSEDS

SEQ ID NO: 1610 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGGRQKHRLTCPSCDSYEKKPPKEFLERFKSLLQKMIHQHLSSRTHGSEDS

SEQ ID NO: 1611 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSTNPGGRQKHRLTCPSCDSYEKKPPKEFLERFKSLLQKMIHQHLSSRTHGSEDS

SEQ ID NO: 1612 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGQDQKHTLTCPSCDSYEKKPPKEFLERFKSLLQKMIHQHLSSRTHGSEDS

SEQ ID NO: 1613 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSDNAGRRQKHRLTCPSCDSYEKKPPKEFLERFKSLLQKMIHQHLSSRTHGSEDS

SEQ ID NO: 1614 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGRQKDTLECPSCDSYEKKPPKEFLERFKSLLQKMIHQHLSSRTHGSEDS

SEQ ID NO: 1615 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGQGQKDRLTCPSCDSYEKKPPKEFLERFKSLLQKMIHQHLSSRTHGSEDS

SEQ ID NO: 1616 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINESIKKLKRKPPSTNPGRRQKHRLTCPSCDSYEKKPPKEFLERFKSLLQKMIHQHLSSRTHGSEDS

SEQ ID NO: 1617 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGQRQKHTLTCPSCDSYEKKPPKEFLERFKSLLQKMIHQHLSSRTHGSEDS

SEQ ID NO: 1618 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGGRQKHRLTCPSCDSYEKKPPKEFLERFKSLLQKMIHQHLSSRTHGSEDS

SEQ ID NO: 1619 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSDNAGGRQKHRLTCPSCDSYEKKPPKEFLERFKSLLQKMIHQHLSSRTHGSEDS

SEQ ID NO: 1620 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRDQKDRLECPSCDSYEKKPPKEFLERFKSLLQKMIHQHLSSRTHGSEDS

SEQ ID NO: 1621 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGRDQKDRLTCPSCDSYEKKPPKEFLERFKSLLQKMIHQHLSSRTHGSEDS

SEQ ID NO: 1622 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSTNPGRDQKHRLTCPSCDSYEKKPPKEFLERFKSLLQKMIHQHLSSRTHGSEDS

SEQ ID NO: 1623 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGGGQKHRLTCPSCDSYEKKPPKEFLERFKSLLQKMIHQHLSSRTHGSEDS

SEQ ID NO: 1624 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSTNAGRRQKHRLTCPSCDSYEKKPPKEFLERFKSLLQKMIHQHLSSRTHGSEDS

SEQ ID NO: 1625 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSTNAGQRQKHRLTCPSCDSYEKKPPKEFLERFKSLLQKMIHQHLSSRTHGSEDS

SEQ ID NO: 1626 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSTNAGQGQKHRLTCPSCDSYEKKPPKEFLERFKSLLQKMIHQHLSSRTHGSEDS

SEQ ID NO: 1627 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGRRQKHRLECPSCDSYEKKPPKEFLERFKSLLQKMIHQHLSSRTHGSEDS

SEQ ID NO: 1628 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRDQKDRLECPSCDSYEKKPPKEFLERFKSLLQKMIHQHLSSRTHGSEDS

SEQ ID NO: 1629 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINESIKKLKRKVPSTNAGRRQKHRLTCPSCDSYEKKPPKEFLERFKSLLQKMIHQHLSSRTHGSEDS

SEQ ID NO: 1630 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSDNPGRRQKHRLTCPSCDSYEKKPPKEFLERFKSLLQKMIHQHLSSRTHGSEDS

SEQ ID NO: 1631 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKVPSTNPGRRQKHRLTCPSCDSYEKKPPKEFLERFKSLLQKMIHQHLSSRTHGSEDS

SEQ ID NO: 1632 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGQGQKDRLTCPSCDSYEKKPPKEFLERFKSLLQKMIHQHLSSRTHGSEDS

SEQ ID NO: 1633 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGDQKHTLECPSCDSYEKKPPKEFLERFKSLLQKMIHQHLSSRTHGSEDS

SEQ ID NO: 1634 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGQRQKDRLTCPSCDSYEKKPPKEFLERFKSLLQKMIHQHLSSRTHGSEDS

SEQ ID NO: 1635 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRGQKHRLTCPSCDSYEKKPPKEFLERFKSLLQKMIHQHLSSRTHGSEDS

SEQ ID NO: 1636 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGQDQKHRLTCPSCDSYEKKPPKEFLERFKSLLQKMIHQHLSSRTHGSEDS

SEQ ID NO: 1637 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGRGQKHRLECPSCDSYEKKPPKEFLERFKSLLQKMIHQHLSSRTHGSEDS

SEQ ID NO: 1638 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSDNAGRDQKHRLTCPSCDSYEKKPPKEFLERFKSLLQKMIHQHLSSRTHGSEDS

SEQ ID NO: 1639 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNAGGGQKHRLTCPSCDSYEKKPPKEFLERFKSLLQKMIHQHLSSRTHGSEDS

SEQ ID NO: 1640 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKVPSTNAGRRQKHRLTCPSCDSYEKKPPKEFLERFKSLLQKMIHQHLSSRTHGSEDS

SEQ ID NO: 1641 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGQGQKDRLTCPSCDSYEKKPPKEFLERFKSLLQKMIHQHLSSRTHGSEDS

SEQ ID NO: 1642 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGQRQKHRLECPSCDSYEKKPPKEFLERFKSLLQKMIHQHLSSRTHGSEDS

SEQ ID NO: 1643 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSTNAGGGQKHRLTCPSCDSYEKKPPKEFLERFKSLLQKMIHQHLSSRTHGSEDS

SEQ ID NO: 1644 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGRRQKHTLTCPSCDSYEKKPPKEFLERFKSLLQKMIHQHLSSRTHGSEDS

SEQ ID NO: 1645 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGGGQKDRLTCPSCDSYEKKPPKEFLERFKSLLQKMIHQHLSSRTHGSEDS

SEQ ID NO: 1646 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINESIKKLKRKPPSTNAGGRQKHRLTCPSCDSYEKKPPKEFLERFKSLLQKMIHQHLSSRTHGSEDS

SEQ ID NO: 1647 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQGQKDRLECPSCDSYEKKPPKEFLERFKSLLQKMIHQHLSSRTHGSEDS

SEQ ID NO: 1648 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGGRQKDTLTCPSCDSYEKKPPKEFLERFKSLLQKMIHQHLSSRTHGSEDS

SEQ ID NO: 1649 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKVPSTNAGRRQKHRLTCPSCDSYEKKPPKEFLERFKSLLQKMIHQHLSSRTHGSEDS

SEQ ID NO: 1650 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSDNAGRRQKHRLTCPSCDSYEKKPPKEFLERFKSLLQKMIHQHLSSRTHGSEDS

SEQ ID NO: 1651 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGRDQKHTLTCPSCDSYEKKPPKEFLERFKSLLQKMIHQHLSSRTHGSEDS

SEQ ID NO: 1652 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSTNAGGDQKHRLTCPSCDSYEKKPPKEFLERFKSLLQKMIHQHLSSRTHGSEDS

SEQ ID NO: 1653 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGRDQKDRLTCPSCDSYEKKPPKEFLERFKSLLQKMIHQHLSSRTHGSEDS

SEQ ID NO: 1654 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGQRQKDTLTCPSCDSYEKKPPKEFLERFKSLLQKMIHQHLSSRTHGSEDS

SEQ ID NO: 1655 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGQRQKDRLTCPSCDSYEKKPPKEFLERFKSLLQKMIHQHLSSRTHGSEDS

SEQ ID NO: 1656 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGGRQKHTLTCPSCDSYEKKPPKEFLERFKSLLQKMIHQHLSSRTHGSEDS

SEQ ID NO: 1657 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRDQKDTLTCPSCDSYEKKPPKEFLERFKSLLQKMIHQHLSSRTHGSEDS

SEQ ID NO: 1658 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINESIKKLKRKPPSDNAGRRQKHRLTCPSCDSYEKKPPKEFLERFKSLLQKMIHQHLSSRTHGSEDS

SEQ ID NO: 1659 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGGRQKDRLTCPSCDSYEKKPPKEFLERFKSLLQKMIHQHLSSRTHGSEDS

SEQ ID NO: 1660 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGRRQKDRLECPSCDSYEKKPPKEFLERFKSLLQKMIHQHLSSRTHGSEDS

SEQ ID NO: 1661 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGRDQKHTLTCPSCDSYEKKPPKEFLERFKSLLQKMIHQHLSSRTHGSEDS

SEQ ID NO: 1662 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSTNAGGGQKHRLTCPSCDSYEKKPPKEFLERFKSLLQKMIHQHLSSRTHGSEDS

SEQ ID NO: 1663 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSTNPGRGQKHRLTCPSCDSYEKKPPKEFLERFKSLLQKMIHQHLSSRTHGSEDS

SEQ ID NO: 1664 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNPGRRQKHRLECPSCDSYEKKPPKEFLERFKSLLQKMIHQHLSSRTHGSEDS

SEQ ID NO: 1665 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNPGRRQKHRLECPSCDSYEKKPPKEFLERFKSLLQKMIHQHLSSRTHGSEDS

SEQ ID NO: 1666 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGRRQKHTLECPSCDSYEKKPPKEFLERFKSLLQKMIHQHLSSRTHGSEDS

SEQ ID NO: 1667 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGQGQKHRLTCPSCDSYEKKPPKEFLERFKSLLQKMIHQHLSSRTHGSEDS

SEQ ID NO: 1668 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGRRQKHRLTCPSCDSYEKKPPKEFLERFKSLLQKMIHQHLSSRTHGSEDS

SEQ ID NO: 1669 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRRQKDTLECPSCDSYEKKPPKEFLERFKSLLQKMIHQHLSSRTHGSEDS

SEQ ID NO: 1670 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINESIKKLKRKPPSTNAGRGQKHRLTCPSCDSYEKKPPKEFLERFKSLLQKMIHQHLSSRTHGSEDS

SEQ ID NO: 1671 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGGDQKHRLTCPSCDSYEKKPPKEFLERFKSLLQKMIHQHLSSRTHGSEDS

SEQ ID NO: 1672 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGQDQKHRLECPSCDSYEKKPPKEFLERFKSLLQKMIHQHLSSRTHGSEDS

SEQ ID NO: 1673 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRDQKDRLTCPSCDSYEKKPPKEFLERFKSLLQKMIHQHLSSRTHGSEDS

SEQ ID NO: 1674 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSTNAGGGQKHRLTCPSCDSYEKKPPKEFLERFKSLLQKMIHQHLSSRTHGSEDS

SEQ ID NO: 1675 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 1676 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGRDQKHRLECPSCDSYEKKPPKEFLERFKSLLQKMIHQHLSSRTHGSEDS

SEQ ID NO: 1677 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGRRQKHRLECPSCDSYEKKPPKEFLERFKSLLQKMIHQHLSSRTHGSEDS

SEQ ID NO: 1678 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKVPSTNAGGRQKHRLTCPSCDSYEKKPPKEFLERFKSLLQKMIHQHLSSRTHGSEDS

SEQ ID NO: 1679 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGGRQKDTLTCPSCDSYEKKPPKEFLERFKSLLQKMIHQHLSSRTHGSEDS

SEQ ID NO: 1680 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRRQKDTLECPSCDSYEKKPPKEFLERFKSLLQKMIHQHLSSRTHGSEDS

SEQ ID NO: 1681 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKPPSTNAGQDQKHRLTCPSCDSYEKKPPKEFLERFKSLLQKMIHQHLSSRTHGSEDS

SEQ ID NO: 1682 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSDNPGRRQKHRLTCPSCDSYEKKPPKEFLERFKSLLQKMIHQHLSSRTHGSEDS

SEQ ID NO: 1683 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKVPSTNAGRDQKHRLTCPSCDSYEKKPPKEFLERFKSLLQKMIHQHLSSRTHGSEDS

SEQ ID NO: 1684 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGQDQKHRLTCPSCDSYEKKPPKEFLERFKSLLQKMIHQHLSSRTHGSEDS

SEQ ID NO: 1685 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRGQKDRLECPSCDSYEKKPPKEFLERFKSLLQKMIHQHLSSRTHGSEDS

SEQ ID NO: 1686 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSTNAGGGQKHRLTCPSCDSYEKKPPKEFLERFKSLLQKMIHQHLSSRTHGSEDS

SEQ ID NO: 1687 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGRGQKDRLTCPSCDSYEKKPPKEFLERFKSLLQKMIHQHLSSRTHGSEDS

SEQ ID NO: 1688 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSDNAGRRQKHRLECPSCDSYEKKPPKEFLERFKSLLQKMIHQHLSSRTHGSEDS

SEQ ID NO: 1689 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGQRQKDRLTCPSCDSYEKKPPKEFLERFKSLLQKMIHQHLSSRTHGSEDS

SEQ ID NO: 1690 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRDQKHTLECPSCDSYEKKPPKEFLERFKSLLQKMIHQHLSSRTHGSEDS

SEQ ID NO: 1691 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGRRQKDRLECPSCDSYEKKPPKEFLERFKSLLQKMIHQHLSSRTHGSEDS

SEQ ID NO: 1692 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGGDQKHTLTCPSCDSYEKKPPKEFLERFKSLLQKMIHQHLSSRTHGSEDS

SEQ ID NO: 1693 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGRRQKDRLECPSCDSYEKKPPKEFLERFKSLLQKMIHQHLSSRTHGSEDS

SEQ ID NO: 1694 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGRDQKHRLTCPSCDSYEKKPPKEFLERFKSLLQKMIHQHLSSRTHGSEDS

SEQ ID NO: 1695 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSTNAGQGQKHRLTCPSCDSYEKKPPKEFLERFKSLLQKMIHQHLSSRTHGSEDS

SEQ ID NO: 1696 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINESIKKLKRKPPSTNAGRGQKHRLTCPSCDSYEKKPPKEFLERFKSLLQKMIHQHLSSRTHGSEDS

SEQ ID NO: 1697 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNPGRRQKHTLTCPSCDSYEKKPPKEFLERFKSLLQKMIHQHLSSRTHGSEDS

SEQ ID NO: 1698 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 1699 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSTNAGQDQKHRLTCPSCDSYEKKPPKEFLERFKSLLQKMIHQHLSSRTHGSEDS

SEQ ID NO: 1700 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGGRQKDRLECPSCDSYEKKPPKEFLERFKSLLQKMIHQHLSSRTHGSEDS

SEQ ID NO: 1701 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSTNAGQRQKHRLTCPSCDSYEKKPPKEFLERFKSLLQKMIHQHLSSRTHGSEDS

SEQ ID NO: 1702 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNPGRRQKHRLECPSCDSYEKKPPKEFLERFKSLLQKMIHQHLSSRTHGSEDS

SEQ ID NO: 1703 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSTNAGQGQKHRLTCPSCDSYEKKPPKEFLERFKSLLQKMIHQHLSSRTHGSEDS

SEQ ID NO: 1704 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRRQKDTLECPSCDSYEKKPPKEFLERFKSLLQKMIHQHLSSRTHGSEDS

SEQ ID NO: 1705 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSDNAGRDQKHRLTCPSCDSYEKKPPKEFLERFKSLLQKMIHQHLSSRTHGSEDS

SEQ ID NO: 1706 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQDAQLKSANTGNNERIINVSIKKLKRKPPSTNPGRRQKHRLTCPSCDSYEKKPPKEFLERFKSLLQKMIHQHLSSRTHGSEDS

SEQ ID NO: 1707 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGQDQKHTLTCPSCDSYEKKPPKEFLERFKSLLQKMIHQHLSSRTHGSEDS

SEQ ID NO: 1708 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSTNAGGDQKHRLTCPSCDSYEKKPPKEFLERFKSLLQKMIHQHLSSRTHGSEDS

SEQ ID NO: 1709 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRRQKHTLECPSCDSYEKKPPKEFLERFKSLLQKMIHQHLSSRTHGSEDS

SEQ ID NO: 1710 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRDQKHRLECPSCDSYEKKPPKEFLERFKSLLQKMIHQHLSSRTHGSEDS

SEQ ID NO: 1711 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGRGQKHTLTCPSCDSYEKKPPKEFLERFKSLLQKMIHQHLSSRTHGSEDS

SEQ ID NO: 1712 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGGRQKDRLTCPSCDSYEKKPPKEFLERFKSLLQKMIHQHLSSRTHGSEDS

SEQ ID NO: 1713 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGGRQKDRLTCPSCDSYEKKPPKEFLERFKSLLQKMIHQHLSSRTHGSEDS

SEQ ID NO: 1714 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 1715 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGRRQKHRLTCPSCDSYEKKPPKEFLERFKSLLQKMIHQHLSSRTHGSEDS

SEQ ID NO: 1716 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQDAQLKSANTGNNERIINVSIKKLKRKPPSTNPGRRQKHRLTCPSCDSYEKKPPKEFLERFKSLLQKMIHQHLSSRTHGSEDS

SEQ ID NO: 1717 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNPGRDQKHRLTCPSCDSYEKKPPKEFLERFKSLLQKMIHQHLSSRTHGSEDS

SEQ ID NO: 1718 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINESIKKLKRKPPSTNAGRRQKHRLTCPSCDSYEKKPPKEFLERFKSLLQKMIHQHLSSRTHGSEDS

SEQ ID NO: 1719 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGQRQKDTLTCPSCDSYEKKPPKEFLERFKSLLQKMIHQHLSSRTHGSEDS

SEQ ID NO: 1720 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGQRQKDRLECPSCDSYEKKPPKEFLERFKSLLQKMIHQHLSSRTHGSEDS

SEQ ID NO: 1721 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNPGRRQKHTLTCPSCDSYEKKPPKEFLERFKSLLQKMIHQHLSSRTHGSEDS

SEQ ID NO: 1722 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSDNAGQRQKHRLTCPSCDSYEKKPPKEFLERFKSLLQKMIHQHLSSRTHGSEDS

SEQ ID NO: 1723 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQDAQLKSANTGNNERIINVSIKKLKRKVPSTNAGRRQKHRLTCPSCDSYEKKPPKEFLERFKSLLQKMIHQHLSSRTHGSEDS

SEQ ID NO: 1724 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGRRQKDTLTCPSCDSYEKKPPKEFLERFKSLLQKMIHQHLSSRTHGSEDS

SEQ ID NO: 1725 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKVPSTNAGRRQKHRLTCPSCDSYEKKPPKEFLERFKSLLQKMIHQHLSSRTHGSEDS

SEQ ID NO: 1726 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGQGQKHTLTCPSCDSYEKKPPKEFLERFKSLLQKMIHQHLSSRTHGSEDS

SEQ ID NO: 1727 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQDQKHTLECPSCDSYEKKPPKEFLERFKSLLQKMIHQHLSSRTHGSEDS

SEQ ID NO: 1728 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGQGQKHRLECPSCDSYEKKPPKEFLERFKSLLQKMIHQHLSSRTHGSEDS

SEQ ID NO: 1729 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINESIKKLKRKPPSTNPGRRQKHRLTCPSCDSYEKKPPKEFLERFKSLLQKMIHQHLSSRTHGSEDS

SEQ ID NO: 1730 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGQDQKHRLTCPSCDSYEKKPPKEFLERFKSLLQKMIHQHLSSRTHGSEDS

SEQ ID NO: 1731 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSDNAGGRQKHRLTCPSCDSYEKKPPKEFLERFKSLLQKMIHQHLSSRTHGSEDS

SEQ ID NO: 1732 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRRQKHTLECPSCDSYEKKPPKEFLERFKSLLQKMIHQHLSSRTHGSEDS

SEQ ID NO: 1733 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSTNAGQGQKHRLTCPSCDSYEKKPPKEFLERFKSLLQKMIHQHLSSRTHGSEDS

SEQ ID NO: 1734 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSDNAGQGQKHRLTCPSCDSYEKKPPKEFLERFKSLLQKMIHQHLSSRTHGSEDS

SEQ ID NO: 1735 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGGGQKHTLTCPSCDSYEKKPPKEFLERFKSLLQKMIHQHLSSRTHGSEDS

SEQ ID NO: 1736 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRDQKDRLECPSCDSYEKKPPKEFLERFKSLLQKMIHQHLSSRTHGSEDS

SEQ ID NO: 1737 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGQGQKHRLTCPSCDSYEKKPPKEFLERFKSLLQKMIHQHLSSRTHGSEDS

SEQ ID NO: 1738 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGGDQKHTLTCPSCDSYEKKPPKEFLERFKSLLQKMIHQHLSSRTHGSEDS

SEQ ID NO: 1739 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGRRQKDTLTCPSCDSYEKKPPKEFLERFKSLLQKMIHQHLSSRTHGSEDS

SEQ ID NO: 1740 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQDQKHTLTCPSCDSYEKKPPKEFLERFKSLLQKMIHQHLSSRTHGSEDS

SEQ ID NO: 1741 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSTNPGRDQKHRLTCPSCDSYEKKPPKEFLERFKSLLQKMIHQHLSSRTHGSEDS

SEQ ID NO: 1742 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNPGRGQKHRLTCPSCDSYEKKPPKEFLERFKSLLQKMIHQHLSSRTHGSEDS

SEQ ID NO: 1743 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGGQKDTLTCPSCDSYEKKPPKEFLERFKSLLQKMIHQHLSSRTHGSEDS

SEQ ID NO: 1744 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRRQKDRLTCPSCDSYEKKPPKEFLERFKSLLQKMIHQHLSSRTHGSEDS

SEQ ID NO: 1745 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRGQKDRLECPSCDSYEKKPPKEFLERFKSLLQKMIHQHLSSRTHGSEDS

SEQ ID NO: 1746 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQRQKDTLECPSCDSYEKKPPKEFLERFKSLLQKMIHQHLSSRTHGSEDS

SEQ ID NO: 1747 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGGGQKHTLTCPSCDSYEKKPPKEFLERFKSLLQKMIHQHLSSRTHGSEDS

SEQ ID NO: 1748 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNAGRRQKHRLECPSCDSYEKKPPKEFLERFKSLLQKMIHQHLSSRTHGSEDS

SEQ ID NO: 1749 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSTNAGRGQKHRLTCPSCDSYEKKPPKEFLERFKSLLQKMIHQHLSSRTHGSEDS

SEQ ID NO: 1750 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSDNAGGRQKHRLTCPSCDSYEKKPPKEFLERFKSLLQKMIHQHLSSRTHGSEDS

SEQ ID NO: 1751 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINESIKKLKRKPPSDNAGRRQKHRLTCPSCDSYEKKPPKEFLERFKSLLQKMIHQHLSSRTHGSEDS

SEQ ID NO: 1752 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSTNAGGDQKHRLTCPSCDSYEKKPPKEFLERFKSLLQKMIHQHLSSRTHGSEDS

SEQ ID NO: 1753 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGQRQKDRLECPSCDSYEKKPPKEFLERFKSLLQKMIHQHLSSRTHGSEDS

SEQ ID NO: 1754 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSTNAGQDQKHRLTCPSCDSYEKKPPKEFLERFKSLLQKMIHQHLSSRTHGSEDS

SEQ ID NO: 1755 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSDNAGRDQKHRLTCPSCDSYEKKPPKEFLERFKSLLQKMIHQHLSSRTHGSEDS

SEQ ID NO: 1756 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKVPSTNAGRDQKHRLTCPSCDSYEKKPPKEFLERFKSLLQKMIHQHLSSRTHGSEDS

SEQ ID NO: 1757 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGGRQKDRLTCPSCDSYEKKPPKEFLERFKSLLQKMIHQHLSSRTHGSEDS

SEQ ID NO: 1758 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGRDQKHTLTCPSCDSYEKKPPKEFLERFKSLLQKMIHQHLSSRTHGSEDS

SEQ ID NO: 1759 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSTNPGRRQKHRLTCPSCDSYEKKPPKEFLERFKSLLQKMIHQHLSSRTHGSEDS

SEQ ID NO: 1760 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGRRQKHTLTCPSCDSYEKKPPKEFLERFKSLLQKMIHQHLSSRTHGSEDS

SEQ ID NO: 1761 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGRGQKDRLTCPSCDSYEKKPPKEFLERFKSLLQKMIHQHLSSRTHGSEDS

SEQ ID NO: 1762 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSDNAGQRQKHRLTCPSCDSYEKKPPKEFLERFKSLLQKMIHQHLSSRTHGSEDS

SEQ ID NO: 1763 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSTNAGRGQKHRLTCPSCDSYEKKPPKEFLERFKSLLQKMIHQHLSSRTHGSEDS

SEQ ID NO: 1764 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGGGQKDRLTCPSCDSYEKKPPKEFLERFKSLLQKMIHQHLSSRTHGSEDS

SEQ ID NO: 1765 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSDNAGRDQKHRLTCPSCDSYEKKPPKEFLERFKSLLQKMIHQHLSSRTHGSEDS

SEQ ID NO: 1766 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRGQKDTLTCPSCDSYEKKPPKEFLERFKSLLQKMIHQHLSSRTHGSEDS

SEQ ID NO: 1767 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKVPSTNAGRDQKHRLTCPSCDSYEKKPPKEFLERFKSLLQKMIHQHLSSRTHGSEDS

SEQ ID NO: 1768 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGQRQKHRLTCPSCDSYEKKPPKEFLERFKSLLQKMIHQHLSSRTHGSEDS

SEQ ID NO: 1769 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSDNAGRGQKHRLTCPSCDSYEKKPPKEFLERFKSLLQKMIHQHLSSRTHGSEDS

SEQ ID NO: 1770 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSTNPGRDQKHRLTCPSCDSYEKKPPKEFLERFKSLLQKMIHQHLSSRTHGSEDS

SEQ ID NO: 1771 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSTNAGRDQKHRLTCPSCDSYEKKPPKEFLERFKSLLQKMIHQHLSSRTHGSEDS

SEQ ID NO: 1772 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGQRQKHTLECPSCDSYEKKPPKEFLERFKSLLQKMIHQHLSSRTHGSEDS

SEQ ID NO: 1773 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRDQKHTLTCPSCDSYEKKPPKEFLERFKSLLQKMIHQHLSSRTHGSEDS

SEQ ID NO: 1774 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGQRQKHTLTCPSCDSYEKKPPKEFLERFKSLLQKMIHQHLSSRTHGSEDS

SEQ ID NO: 1775 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGRGQKHTLTCPSCDSYEKKPPKEFLERFKSLLQKMIHQHLSSRTHGSEDS

SEQ ID NO: 1776 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKVPSTNPGRRQKHRLTCPSCDSYEKKPPKEFLERFKSLLQKMIHQHLSSRTHGSEDS

SEQ ID NO: 1777 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSTNPGQDQKHRLTCPSCDSYEKKPPKEFLERFKSLLQKMIHQHLSSRTHGSEDS

SEQ ID NO: 1778 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQGQKDTLTCPSCDSYEKKPPKEFLERFKSLLQKMIHQHLSSRTHGSEDS

SEQ ID NO: 1779 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGQRQKDRLECPSCDSYEKKPPKEFLERFKSLLQKMIHQHLSSRTHGSEDS

SEQ ID NO: 1780 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGRRQKDRLECPSCDSYEKKPPKEFLERFKSLLQKMIHQHLSSRTHGSEDS

SEQ ID NO: 1781 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSDNAGQRQKHRLTCPSCDSYEKKPPKEFLERFKSLLQKMIHQHLSSRTHGSEDS

SEQ ID NO: 1782 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSDNAGQRQKHRLTCPSCDSYEKKPPKEFLERFKSLLQKMIHQHLSSRTHGSEDS

SEQ ID NO: 1783 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGGGQKHRLTCPSCDSYEKKPPKEFLERFKSLLQKMIHQHLSSRTHGSEDS

SEQ ID NO: 1784 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGGRQKHTLTCPSCDSYEKKPPKEFLERFKSLLQKMIHQHLSSRTHGSEDS

SEQ ID NO: 1785 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRDQKDTLTCPSCDSYEKKPPKEFLERFKSLLQKMIHQHLSSRTHGSEDS

SEQ ID NO: 1786 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRRQKHTLTCPSCDSYEKKPPKEFLERFKSLLQKMIHQHLSSRTHGSEDS

SEQ ID NO: 1787 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRGQKHTLECPSCDSYEKKPPKEFLERFKSLLQKMIHQHLSSRTHGSEDS

SEQ ID NO: 1788 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSTNPGRRQKHRLTCPSCDSYEKKPPKEFLERFKSLLQKMIHQHLSSRTHGSEDS

SEQ ID NO: 1789 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGRRQKHTLTCPSCDSYEKKPPKEFLERFKSLLQKMIHQHLSSRTHGSEDS

SEQ ID NO: 1790 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSTNAGGGQKHRLTCPSCDSYEKKPPKEFLERFKSLLQKMIHQHLSSRTHGSEDS

SEQ ID NO: 1791 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGQGQKHRLTCPSCDSYEKKPPKEFLERFKSLLQKMIHQHLSSRTHGSEDS

SEQ ID NO: 1792 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKVPSTNPGRRQKHRLTCPSCDSYEKKPPKEFLERFKSLLQKMIHQHLSSRTHGSEDS

SEQ ID NO: 1793 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRGQKDTLECPSCDSYEKKPPKEFLERFKSLLQKMIHQHLSSRTHGSEDS

SEQ ID NO: 1794 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKVPSTNPGRRQKHRLTCPSCDSYEKKPPKEFLERFKSLLQKMIHQHLSSRTHGSEDS

SEQ ID NO: 1795 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINESIKKLKRKPPSTNAGRRQKHRLTCPSCDSYEKKPPKEFLERFKSLLQKMIHQHLSSRTHGSEDS

SEQ ID NO: 1796 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGQRQKDTLTCPSCDSYEKKPPKEFLERFKSLLQKMIHQHLSSRTHGSEDS

SEQ ID NO: 1797 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRGQKDRLECPSCDSYEKKPPKEFLERFKSLLQKMIHQHLSSRTHGSEDS

SEQ ID NO: 1798 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSDNPGRRQKHRLTCPSCDSYEKKPPKEFLERFKSLLQKMIHQHLSSRTHGSEDS

SEQ ID NO: 1799 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGDQKDRLTCPSCDSYEKKPPKEFLERFKSLLQKMIHQHLSSRTHGSEDS

SEQ ID NO: 1800 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGRDQKHRLTCPSCDSYEKKPPKEFLERFKSLLQKMIHQHLSSRTHGSEDS

SEQ ID NO: 1801 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGQGQKHRLECPSCDSYEKKPPKEFLERFKSLLQKMIHQHLSSRTHGSEDS

SEQ ID NO: 1802 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGRRQKHRLECPSCDSYEKKPPKEFLERFKSLLQKMIHQHLSSRTHGSEDS

SEQ ID NO: 1803 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRGQKDTLTCPSCDSYEKKPPKEFLERFKSLLQKMIHQHLSSRTHGSEDS

SEQ ID NO: 1804 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRDQKDRLTCPSCDSYEKKPPKEFLERFKSLLQKMIHQHLSSRTHGSEDS

SEQ ID NO: 1805 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGGGQKHRLECPSCDSYEKKPPKEFLERFKSLLQKMIHQHLSSRTHGSEDS

SEQ ID NO: 1806 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKVPSTNPGRRQKHRLTCPSCDSYEKKPPKEFLERFKSLLQKMIHQHLSSRTHGSEDS

SEQ ID NO: 1807 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSDNAGQRQKHRLTCPSCDSYEKKPPKEFLERFKSLLQKMIHQHLSSRTHGSEDS

SEQ ID NO: 1808 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQGQKHTLECPSCDSYEKKPPKEFLERFKSLLQKMIHQHLSSRTHGSEDS

SEQ ID NO: 1809 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSDNAGGRQKHRLTCPSCDSYEKKPPKEFLERFKSLLQKMIHQHLSSRTHGSEDS

SEQ ID NO: 1810 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRDQKHRLECPSCDSYEKKPPKEFLERFKSLLQKMIHQHLSSRTHGSEDS

SEQ ID NO: 1811 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGGRQKDRLECPSCDSYEKKPPKEFLERFKSLLQKMIHQHLSSRTHGSEDS

SEQ ID NO: 1812 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKPPSTNAGGDQKHRLTCPSCDSYEKKPPKEFLERFKSLLQKMIHQHLSSRTHGSEDS

SEQ ID NO: 1813 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNPGRDQKHRLTCPSCDSYEKKPPKEFLERFKSLLQKMIHQHLSSRTHGSEDS

SEQ ID NO: 1814 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGGGQKHTLTCPSCDSYEKKPPKEFLERFKSLLQKMIHQHLSSRTHGSEDS

SEQ ID NO: 1815 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGGGQKDRLTCPSCDSYEKKPPKEFLERFKSLLQKMIHQHLSSRTHGSEDS

SEQ ID NO: 1816 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGGQKDRLECPSCDSYEKKPPKEFLERFKSLLQKMIHQHLSSRTHGSEDS

SEQ ID NO: 1817 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRDQKHTLTCPSCDSYEKKPPKEFLERFKSLLQKMIHQHLSSRTHGSEDS

SEQ ID NO: 1818 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKVPSTNAGRRQKHRLTCPSCDSYEKKPPKEFLERFKSLLQKMIHQHLSSRTHGSEDS

SEQ ID NO: 1819 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNPGRRQKHRLTCPSCDSYEKKPPKEFLERFKSLLQKMIHQHLSSRTHGSEDS

SEQ ID NO: 1820 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGDQKHTLTCPSCDSYEKKPPKEFLERFKSLLQKMIHQHLSSRTHGSEDS

SEQ ID NO: 1821 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSDNAGGGQKHRLTCPSCDSYEKKPPKEFLERFKSLLQKMIHQHLSSRTHGSEDS

SEQ ID NO: 1822 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGQRQKDRLTCPSCDSYEKKPPKEFLERFKSLLQKMIHQHLSSRTHGSEDS

SEQ ID NO: 1823 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGGDQKDRLTCPSCDSYEKKPPKEFLERFKSLLQKMIHQHLSSRTHGSEDS

SEQ ID NO: 1824 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQDQKDRLTCPSCDSYEKKPPKEFLERFKSLLQKMIHQHLSSRTHGSEDS

SEQ ID NO: 1825 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSDNAGRRQKDRLTCPSCDSYEKKPPKEFLERFKSLLQKMIHQHLSSRTHGSEDS

SEQ ID NO: 1826 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSDNAGRRQKHRLTCPSCDSYEKKPPKEFLERFKSLLQKMIHQHLSSRTHGSEDS

SEQ ID NO: 1827 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNPGQGQKHRLTCPSCDSYEKKPPKEFLERFKSLLQKMIHQHLSSRTHGSEDS

SEQ ID NO: 1828 - protein, 162 aa, synthetic construct
MRSSPGNMERIVICLMVIFLGTLVHKSSSQGQDRFMIRMRQLIDTVDQLKNYVNDLVPEFLPAPEDVETGCEWSAFSCFQKAQLKSANTGNNERIINVSIKKLKRKPPSTNAGRDQKHRLTCPSCDSYEKKPPKEFLERFKSLLQKMIHQHLSSRTHGSEDS

SEQ ID NO: 1829 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGGGQKHRLTCPSCDSYEKKPPKEFLERFKSLLQKMIHQHLSSRTHGSEDS

SEQ ID NO: 1830 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGQGQKHRLTCPSCDSYEKKPPKEFLERFKSLLQKMIHQHLSSRTHGSEDS

SEQ ID NO: 1831 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKVPSDNAGRRQKHRLTCPSCDSYEKKPPKEFLERFKSLLQKMIHQHLSSRTHGSEDS

SEQ ID NO: 1832 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGGGQKHRLTCPSCDSYEKKPPKEFLERFKSLLQKMIHQHLSSRTHGSEDS

SEQ ID NO: 1833 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGGGQKHRLECPSCDSYEKKPPKEFLERFKSLLQKMIHQHLSSRTHGSEDS

SEQ ID NO: 1834 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGRRQKDTLTCPSCDSYEKKPPKEFLERFKSLLQKMIHQHLSSRTHGSEDS

SEQ ID NO: 1835 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSTNPGGDQKHRLTCPSCDSYEKKPPKEFLERFKSLLQKMIHQHLSSRTHGSEDS

SEQ ID NO: 1836 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRDQKHRLTCPSCDSYEKKPPKEFLERFKSLLQKMIHQHLSSRTHGSEDS

SEQ ID NO: 1837 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINESIKKLKRKPPSTNAGRRQKHRLTCPSCDSYEKKPPKEFLERFKSLLQKMIHQHLSSRTHGSEDS

SEQ ID NO: 1838 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGRRQKDRLECPSCDSYEKKPPKEFLERFKSLLQKMIHQHLSSRTHGSEDS

SEQ ID NO: 1839 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSDNAGGDQKHRLTCPSCDSYEKKPPKEFLERFKSLLQKMIHQHLSSRTHGSEDS

SEQ ID NO: 1840 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRDQKHTLECPSCDSYEKKPPKEFLERFKSLLQKMIHQHLSSRTHGSEDS

SEQ ID NO: 1841 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSTNAGRDQKHRLTCPSCDSYEKKPPKEFLERFKSLLQKMIHQHLSSRTHGSEDS

SEQ ID NO: 1842 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSDNPGRRQKHRLTCPSCDSYEKKPPKEFLERFKSLLQKMIHQHLSSRTHGSEDS

SEQ ID NO: 1843 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGRDQKHRLTCPSCDSYEKKPPKEFLERFKSLLQKMIHQHLSSRTHGSEDS

SEQ ID NO: 1844 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSTNAGRDQKHRLTCPSCDSYEKKPPKEFLERFKSLLQKMIHQHLSSRTHGSEDS

SEQ ID NO: 1845 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSTNAGGRQKHRLTCPSCDSYEKKPPKEFLERFKSLLQKMIHQHLSSRTHGSEDS

SEQ ID NO: 1846 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGQRQKHTLTCPSCDSYEKKPPKEFLERFKSLLQKMIHQHLSSRTHGSEDS

SEQ ID NO: 1847 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 1848 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRGQKHTLECPSCDSYEKKPPKEFLERFKSLLQKMIHQHLSSRTHGSEDS

SEQ ID NO: 1849 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQGQKDRLTCPSCDSYEKKPPKEFLERFKSLLQKMIHQHLSSRTHGSEDS

SEQ ID NO: 1850 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSDNPGRDQKHRLTCPSCDSYEKKPPKEFLERFKSLLQKMIHQHLSSRTHGSEDS

SEQ ID NO: 1851 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGQGQKHTLTCPSCDSYEKKPPKEFLERFKSLLQKMIHQHLSSRTHGSEDS

SEQ ID NO: 1852 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNPGRDQKHRLTCPSCDSYEKKPPKEFLERFKSLLQKMIHQHLSSRTHGSEDS

SEQ ID NO: 1853 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 1854 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 1855 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGRGQKDRLTCPSCDSYEKKPPKEFLERFKSLLQKMIHQHLSSRTHGSEDS

SEQ ID NO: 1856 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNPGRRQKHRLTCPSCDSYEKKPPKEFLERFKSLLQKMIHQHLSSRTHGSEDS

SEQ ID NO: 1857 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRRQKHTLTCPSCDSYEKKPPKEFLERFKSLLQKMIHQHLSSRTHGSEDS

SEQ ID NO: 1858 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGQDQKHRLTCPSCDSYEKKPPKEFLERFKSLLQKMIHQHLSSRTHGSEDS

SEQ ID NO: 1859 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSDNAGRRQKHRLTCPSCDSYEKKPPKEFLERFKSLLQKMIHQHLSSRTHGSEDS

SEQ ID NO: 1860 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGRGQKHRLTCPSCDSYEKKPPKEFLERFKSLLQKMIHQHLSSRTHGSEDS

SEQ ID NO: 1861 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSTNPGRDQKHRLTCPSCDSYEKKPPKEFLERFKSLLQKMIHQHLSSRTHGSEDS

SEQ ID NO: 1862 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGGRQKHRLECPSCDSYEKKPPKEFLERFKSLLQKMIHQHLSSRTHGSEDS

SEQ ID NO: 1863 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNPGRRQKDRLTCPSCDSYEKKPPKEFLERFKSLLQKMIHQHLSSRTHGSEDS

SEQ ID NO: 1864 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGRRQKHRLECPSCDSYEKKPPKEFLERFKSLLQKMIHQHLSSRTHGSEDS

SEQ ID NO: 1865 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKPPSTNAGQGQKHRLTCPSCDSYEKKPPKEFLERFKSLLQKMIHQHLSSRTHGSEDS

SEQ ID NO: 1866 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSDNAGRGQKHRLTCPSCDSYEKKPPKEFLERFKSLLQKMIHQHLSSRTHGSEDS

SEQ ID NO: 1867 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNAGQGQKHRLTCPSCDSYEKKPPKEFLERFKSLLQKMIHQHLSSRTHGSEDS

SEQ ID NO: 1868 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRDQKHTLECPSCDSYEKKPPKEFLERFKSLLQKMIHQHLSSRTHGSEDS

SEQ ID NO: 1869 - protein, 162 aa, synthetic construct
MRSSPGNMERIVICLMVIFLGTLVHKSSSQGQDRFMIRMRQLIDTVDQLKNYVNDLVPEFLPAPEDVETGCEWSAFSCFQKAQLKSANTGNNERIINESIKKLKRKPPSTNAGRRQKHRLTCPSCDSYEKKPPKEFLERFKSLLQKMIHQHLSSRTHGSEDS

SEQ ID NO: 1870 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGRDQKHRLECPSCDSYEKKPPKEFLERFKSLLQKMIHQHLSSRTHGSEDS

SEQ ID NO: 1871 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKPPSTNPGRRQKHRLTCPSCDSYEKKPPKEFLERFKSLLQKMIHQHLSSRTHGSEDS

SEQ ID NO: 1872 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKVPSTNAGRGQKHRLTCPSCDSYEKKPPKEFLERFKSLLQKMIHQHLSSRTHGSEDS

SEQ ID NO: 1873 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSDNAGRGQKHRLTCPSCDSYEKKPPKEFLERFKSLLQKMIHQHLSSRTHGSEDS

SEQ ID NO: 1874 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGGGQKHRLECPSCDSYEKKPPKEFLERFKSLLQKMIHQHLSSRTHGSEDS

SEQ ID NO: 1875 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGGRQKHTLECPSCDSYEKKPPKEFLERFKSLLQKMIHQHLSSRTHGSEDS

SEQ ID NO: 1876 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRDQKHTLECPSCDSYEKKPPKEFLERFKSLLQKMIHQHLSSRTHGSEDS

SEQ ID NO: 1877 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGQGQKDRLTCPSCDSYEKKPPKEFLERFKSLLQKMIHQHLSSRTHGSEDS

SEQ ID NO: 1878 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGGRQKHTLECPSCDSYEKKPPKEFLERFKSLLQKMIHQHLSSRTHGSEDS

SEQ ID NO: 1879 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSTNAGQDQKHRLTCPSCDSYEKKPPKEFLERFKSLLQKMIHQHLSSRTHGSEDS

SEQ ID NO: 1880 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGGRQKHTLTCPSCDSYEKKPPKEFLERFKSLLQKMIHQHLSSRTHGSEDS

SEQ ID NO: 1881 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSDNAGQRQKHRLTCPSCDSYEKKPPKEFLERFKSLLQKMIHQHLSSRTHGSEDS

SEQ ID NO: 1882 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGGRQKHTLECPSCDSYEKKPPKEFLERFKSLLQKMIHQHLSSRTHGSEDS

SEQ ID NO: 1883 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGQRQKHRLECPSCDSYEKKPPKEFLERFKSLLQKMIHQHLSSRTHGSEDS

SEQ ID NO: 1884 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRDQKHRLECPSCDSYEKKPPKEFLERFKSLLQKMIHQHLSSRTHGSEDS

SEQ ID NO: 1885 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINESIKKLKRKPPSTNAGRGQKHRLTCPSCDSYEKKPPKEFLERFKSLLQKMIHQHLSSRTHGSEDS

SEQ ID NO: 1886 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGQRQKDRLTCPSCDSYEKKPPKEFLERFKSLLQKMIHQHLSSRTHGSEDS

SEQ ID NO: 1887 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGRDQKHRLECPSCDSYEKKPPKEFLERFKSLLQKMIHQHLSSRTHGSEDS

SEQ ID NO: 1888 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRGQKHTLECPSCDSYEKKPPKEFLERFKSLLQKMIHQHLSSRTHGSEDS

SEQ ID NO: 1889 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSTNPGGRQKHRLTCPSCDSYEKKPPKEFLERFKSLLQKMIHQHLSSRTHGSEDS

SEQ ID NO: 1890 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGQRQKHTLECPSCDSYEKKPPKEFLERFKSLLQKMIHQHLSSRTHGSEDS

SEQ ID NO: 1891 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGQRQKHRLECPSCDSYEKKPPKEFLERFKSLLQKMIHQHLSSRTHGSEDS

SEQ ID NO: 1892 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNPGGGQKHRLTCPSCDSYEKKPPKEFLERFKSLLQKMIHQHLSSRTHGSEDS

SEQ ID NO: 1893 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKPPSTNAGRRQKHRLTCPSCDSYEKKPPKEFLERFKSLLQKMIHQHLSSRTHGSEDS

SEQ ID NO: 1894 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGGDQKHRLTCPSCDSYEKKPPKEFLERFKSLLQKMIHQHLSSRTHGSEDS

SEQ ID NO: 1895 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGRGQKHTLTCPSCDSYEKKPPKEFLERFKSLLQKMIHQHLSSRTHGSEDS

SEQ ID NO: 1896 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNAGRRQKHRLECPSCDSYEKKPPKEFLERFKSLLQKMIHQHLSSRTHGSEDS

SEQ ID NO: 1897 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGQRQKHTLTCPSCDSYEKKPPKEFLERFKSLLQKMIHQHLSSRTHGSEDS

SEQ ID NO: 1898 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGGRQKHTLTCPSCDSYEKKPPKEFLERFKSLLQKMIHQHLSSRTHGSEDS

SEQ ID NO: 1899 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRDQKHTLTCPSCDSYEKKPPKEFLERFKSLLQKMIHQHLSSRTHGSEDS

SEQ ID NO: 1900 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNPGQRQKHRLTCPSCDSYEKKPPKEFLERFKSLLQKMIHQHLSSRTHGSEDS

SEQ ID NO: 1901 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSDNAGGDQKHRLTCPSCDSYEKKPPKEFLERFKSLLQKMIHQHLSSRTHGSEDS

SEQ ID NO: 1902 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKPPSDNAGGRQKHRLTCPSCDSYEKKPPKEFLERFKSLLQKMIHQHLSSRTHGSEDS

SEQ ID NO: 1903 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSTNPGQDQKHRLTCPSCDSYEKKPPKEFLERFKSLLQKMIHQHLSSRTHGSEDS

SEQ ID NO: 1904 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 1905 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGGRQKHRLTCPSCDSYEKKPPKEFLERFKSLLQKMIHQHLSSRTHGSEDS

SEQ ID NO: 1906 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGRGQKHRLECPSCDSYEKKPPKEFLERFKSLLQKMIHQHLSSRTHGSEDS

SEQ ID NO: 1907 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKVPSTNAGRDQKHRLTCPSCDSYEKKPPKEFLERFKSLLQKMIHQHLSSRTHGSEDS

SEQ ID NO: 1908 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGQGQKHTLTCPSCDSYEKKPPKEFLERFKSLLQKMIHQHLSSRTHGSEDS

SEQ ID NO: 1909 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGQRQKDRLTCPSCDSYEKKPPKEFLERFKSLLQKMIHQHLSSRTHGSEDS

SEQ ID NO: 1910 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSTNAGQGQKHRLTCPSCDSYEKKPPKEFLERFKSLLQKMIHQHLSSRTHGSEDS

SEQ ID NO: 1911 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSDNPGRDQKHRLTCPSCDSYEKKPPKEFLERFKSLLQKMIHQHLSSRTHGSEDS

SEQ ID NO: 1912 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGQGQKHRLTCPSCDSYEKKPPKEFLERFKSLLQKMIHQHLSSRTHGSEDS

SEQ ID NO: 1913 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSDNAGGRQKHRLTCPSCDSYEKKPPKEFLERFKSLLQKMIHQHLSSRTHGSEDS

SEQ ID NO: 1914 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGRDQKDRLTCPSCDSYEKKPPKEFLERFKSLLQKMIHQHLSSRTHGSEDS

SEQ ID NO: 1915 - protein, 162 aa, synthetic construct
MRSSPGNMERIVICLMVIFLGTLVHKSSSQGQDRIMIRMRQLIDTVDQLKNYVNDLVPEFLPAPEDVETGCEWSAFSCFQKAQLKSANTGNNERIINESIKKLKRKPPSTNAGRRQKHRLTCPSCDSYEKKPPKEFLERFKSLLQKMIHQHLSSRTHGSEDS

SEQ ID NO: 1916 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGGRQKDTLTCPSCDSYEKKPPKEFLERFKSLLQKMIHQHLSSRTHGSEDS

SEQ ID NO: 1917 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRRQKDTLTCPSCDSYEKKPPKEFLERFKSLLQKMIHQHLSSRTHGSEDS

SEQ ID NO: 1918 - protein, 162 aa, synthetic construct
MRSSPGNMERIVICLMVIFLGTLVHKSSSQGQDRIMIRMRQLIDTVDQLKNYVNDLVPEFLPAPEDVETGCEWSAFSCFQKAQLKSANTGNNERIINVSIKKLKRKPPSTNAGRDQKHRLTCPSCDSYEKKPPKEFLERFKSLLQKMIHQHLSSRTHGSEDS

SEQ ID NO: 1919 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSDNAGRGQKHRLTCPSCDSYEKKPPKEFLERFKSLLQKMIHQHLSSRTHGSEDS

SEQ ID NO: 1920 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSTNPGQGQKHRLTCPSCDSYEKKPPKEFLERFKSLLQKMIHQHLSSRTHGSEDS

SEQ ID NO: 1921 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSDNAGGRQKHRLTCPSCDSYEKKPPKEFLERFKSLLQKMIHQHLSSRTHGSEDS

SEQ ID NO: 1922 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKPPSTNPGRDQKHRLTCPSCDSYEKKPPKEFLERFKSLLQKMIHQHLSSRTHGSEDS

SEQ ID NO: 1923 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRGQKDRLTCPSCDSYEKKPPKEFLERFKSLLQKMIHQHLSSRTHGSEDS

SEQ ID NO: 1924 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGGRQKHRLECPSCDSYEKKPPKEFLERFKSLLQKMIHQHLSSRTHGSEDS

SEQ ID NO: 1925 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGQDQKHRLECPSCDSYEKKPPKEFLERFKSLLQKMIHQHLSSRTHGSEDS

SEQ ID NO: 1926 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGQRQKDRLTCPSCDSYEKKPPKEFLERFKSLLQKMIHQHLSSRTHGSEDS

SEQ ID NO: 1927 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGGQKHTLECPSCDSYEKKPPKEFLERFKSLLQKMIHQHLSSRTHGSEDS

SEQ ID NO: 1928 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGRGQKHRLECPSCDSYEKKPPKEFLERFKSLLQKMIHQHLSSRTHGSEDS

SEQ ID NO: 1929 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSTNAGRDQKHRLTCPSCDSYEKKPPKEFLERFKSLLQKMIHQHLSSRTHGSEDS

SEQ ID NO: 1930 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGQRQKDRLTCPSCDSYEKKPPKEFLERFKSLLQKMIHQHLSSRTHGSEDS

SEQ ID NO: 1931 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSTNPGRGQKHRLTCPSCDSYEKKPPKEFLERFKSLLQKMIHQHLSSRTHGSEDS

SEQ ID NO: 1932 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSDNAGQRQKHRLTCPSCDSYEKKPPKEFLERFKSLLQKMIHQHLSSRTHGSEDS

SEQ ID NO: 1933 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGGRQKDRLECPSCDSYEKKPPKEFLERFKSLLQKMIHQHLSSRTHGSEDS

SEQ ID NO: 1934 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINESIKKLKRKPPSTNAGQRQKHRLTCPSCDSYEKKPPKEFLERFKSLLQKMIHQHLSSRTHGSEDS

SEQ ID NO: 1935 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKVPSTNAGRGQKHRLTCPSCDSYEKKPPKEFLERFKSLLQKMIHQHLSSRTHGSEDS

SEQ ID NO: 1936 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSTNAGQGQKHRLTCPSCDSYEKKPPKEFLERFKSLLQKMIHQHLSSRTHGSEDS

SEQ ID NO: 1937 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGGRQKDRLTCPSCDSYEKKPPKEFLERFKSLLQKMIHQHLSSRTHGSEDS

SEQ ID NO: 1938 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGQGQKHRLECPSCDSYEKKPPKEFLERFKSLLQKMIHQHLSSRTHGSEDS

SEQ ID NO: 1939 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQRQKDRLECPSCDSYEKKPPKEFLERFKSLLQKMIHQHLSSRTHGSEDS

SEQ ID NO: 1940 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGQGQKHRLTCPSCDSYEKKPPKEFLERFKSLLQKMIHQHLSSRTHGSEDS

SEQ ID NO: 1941 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGRGQKDRLTCPSCDSYEKKPPKEFLERFKSLLQKMIHQHLSSRTHGSEDS

SEQ ID NO: 1942 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSTNPGRDQKHRLTCPSCDSYEKKPPKEFLERFKSLLQKMIHQHLSSRTHGSEDS

SEQ ID NO: 1943 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSDNAGRGQKHRLTCPSCDSYEKKPPKEFLERFKSLLQKMIHQHLSSRTHGSEDS

SEQ ID NO: 1944 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGGDQKHRLECPSCDSYEKKPPKEFLERFKSLLQKMIHQHLSSRTHGSEDS

SEQ ID NO: 1945 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSDNAGGRQKHRLTCPSCDSYEKKPPKEFLERFKSLLQKMIHQHLSSRTHGSEDS

SEQ ID NO: 1946 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRRQKDRLECPSCDSYEKKPPKEFLERFKSLLQKMIHQHLSSRTHGSEDS

SEQ ID NO: 1947 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINESIKKLKRKVPSTNPGRRQKHRLTCPSCDSYEKKPPKEFLERFKSLLQKMIHQHLSSRTHGSEDS

SEQ ID NO: 1948 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNPGRDQKHRLTCPSCDSYEKKPPKEFLERFKSLLQKMIHQHLSSRTHGSEDS

SEQ ID NO: 1949 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNPGRRQKDRLTCPSCDSYEKKPPKEFLERFKSLLQKMIHQHLSSRTHGSEDS

SEQ ID NO: 1950 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSTNPGGRQKHRLTCPSCDSYEKKPPKEFLERFKSLLQKMIHQHLSSRTHGSEDS

SEQ ID NO: 1951 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGRDQKHRLTCPSCDSYEKKPPKEFLERFKSLLQKMIHQHLSSRTHGSEDS

SEQ ID NO: 1952 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGGRQKHRLECPSCDSYEKKPPKEFLERFKSLLQKMIHQHLSSRTHGSEDS

SEQ ID NO: 1953 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGRDQKHRLECPSCDSYEKKPPKEFLERFKSLLQKMIHQHLSSRTHGSEDS

SEQ ID NO: 1954 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSDNAGQGQKHRLTCPSCDSYEKKPPKEFLERFKSLLQKMIHQHLSSRTHGSEDS

SEQ ID NO: 1955 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 1956 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKVPSTNAGRGQKHRLTCPSCDSYEKKPPKEFLERFKSLLQKMIHQHLSSRTHGSEDS

SEQ ID NO: 1957 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSTNAGGRQKHRLTCPSCDSYEKKPPKEFLERFKSLLQKMIHQHLSSRTHGSEDS

SEQ ID NO: 1958 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNAGRRQKHRLTCPSCDSYEKKPPKEFLERFKSLLQKMIHQHLSSRTHGSEDS

SEQ ID NO: 1959 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRGQKDTLTCPSCDSYEKKPPKEFLERFKSLLQKMIHQHLSSRTHGSEDS

SEQ ID NO: 1960 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSDNPGRRQKHRLTCPSCDSYEKKPPKEFLERFKSLLQKMIHQHLSSRTHGSEDS

SEQ ID NO: 1961 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGGDQKHRLTCPSCDSYEKKPPKEFLERFKSLLQKMIHQHLSSRTHGSEDS

SEQ ID NO: 1962 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGGGQKHTLTCPSCDSYEKKPPKEFLERFKSLLQKMIHQHLSSRTHGSEDS

SEQ ID NO: 1963 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSTNAGQRQKHRLTCPSCDSYEKKPPKEFLERFKSLLQKMIHQHLSSRTHGSEDS

SEQ ID NO: 1964 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGRRQKDRLECPSCDSYEKKPPKEFLERFKSLLQKMIHQHLSSRTHGSEDS

SEQ ID NO: 1965 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQDQKHRLECPSCDSYEKKPPKEFLERFKSLLQKMIHQHLSSRTHGSEDS

SEQ ID NO: 1966 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKVPSDNAGRRQKHRLTCPSCDSYEKKPPKEFLERFKSLLQKMIHQHLSSRTHGSEDS

SEQ ID NO: 1967 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKVPSTNAGGRQKHRLTCPSCDSYEKKPPKEFLERFKSLLQKMIHQHLSSRTHGSEDS

SEQ ID NO: 1968 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSTNPGRRQKHRLTCPSCDSYEKKPPKEFLERFKSLLQKMIHQHLSSRTHGSEDS

SEQ ID NO: 1969 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRDQKDRLTCPSCDSYEKKPPKEFLERFKSLLQKMIHQHLSSRTHGSEDS

SEQ ID NO: 1970 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGRRQKHTLECPSCDSYEKKPPKEFLERFKSLLQKMIHQHLSSRTHGSEDS

SEQ ID NO: 1971 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSDNPGRGQKHRLTCPSCDSYEKKPPKEFLERFKSLLQKMIHQHLSSRTHGSEDS

SEQ ID NO: 1972 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINESIKKLKRKPPSTNAGRRQKHRLTCPSCDSYEKKPPKEFLERFKSLLQKMIHQHLSSRTHGSEDS

SEQ ID NO: 1973 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQRQKDTLTCPSCDSYEKKPPKEFLERFKSLLQKMIHQHLSSRTHGSEDS

SEQ ID NO: 1974 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSTNAGRDQKHRLTCPSCDSYEKKPPKEFLERFKSLLQKMIHQHLSSRTHGSEDS

SEQ ID NO: 1975 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNAGGDQKHRLTCPSCDSYEKKPPKEFLERFKSLLQKMIHQHLSSRTHGSEDS

SEQ ID NO: 1976 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSTNAGRGQKHRLTCPSCDSYEKKPPKEFLERFKSLLQKMIHQHLSSRTHGSEDS

SEQ ID NO: 1977 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRGQKDRLECPSCDSYEKKPPKEFLERFKSLLQKMIHQHLSSRTHGSEDS

SEQ ID NO: 1978 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSTNPGGRQKHRLTCPSCDSYEKKPPKEFLERFKSLLQKMIHQHLSSRTHGSEDS

SEQ ID NO: 1979 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGGGQKHRLTCPSCDSYEKKPPKEFLERFKSLLQKMIHQHLSSRTHGSEDS

SEQ ID NO: 1980 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKVPSTNAGQRQKHRLTCPSCDSYEKKPPKEFLERFKSLLQKMIHQHLSSRTHGSEDS

SEQ ID NO: 1981 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSTNAGRDQKHRLTCPSCDSYEKKPPKEFLERFKSLLQKMIHQHLSSRTHGSEDS

SEQ ID NO: 1982 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNAGRDQKHRLTCPSCDSYEKKPPKEFLERFKSLLQKMIHQHLSSRTHGSEDS

SEQ ID NO: 1983 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSTNPGRGQKHRLTCPSCDSYEKKPPKEFLERFKSLLQKMIHQHLSSRTHGSEDS

SEQ ID NO: 1984 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGGGQKHRLTCPSCDSYEKKPPKEFLERFKSLLQKMIHQHLSSRTHGSEDS

SEQ ID NO: 1985 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSDNAGRDQKHRLTCPSCDSYEKKPPKEFLERFKSLLQKMIHQHLSSRTHGSEDS

SEQ ID NO: 1986 - protein, 162 aa, synthetic construct
MRSSPGNMERIVICLMVIFLGTLVHKSSSQGQDRFMIRMRQLIDTVDQLKNYVNDLVPEFLPAPEDVETGCEWSAFSCFQKAQLKSANTGNNERIINVSIKKLKRKPPSTNAGGRQKHRLTCPSCDSYEKKPPKEFLERFKSLLQKMIHQHLSSRTHGSEDS

SEQ ID NO: 1987 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGRGQKHTLTCPSCDSYEKKPPKEFLERFKSLLQKMIHQHLSSRTHGSEDS

SEQ ID NO: 1988 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRGQKDRLTCPSCDSYEKKPPKEFLERFKSLLQKMIHQHLSSRTHGSEDS

SEQ ID NO: 1989 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGRDQKHTLTCPSCDSYEKKPPKEFLERFKSLLQKMIHQHLSSRTHGSEDS

SEQ ID NO: 1990 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRRQKDTLTCPSCDSYEKKPPKEFLERFKSLLQKMIHQHLSSRTHGSEDS

SEQ ID NO: 1991 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGRDQKHRLTCPSCDSYEKKPPKEFLERFKSLLQKMIHQHLSSRTHGSEDS

SEQ ID NO: 1992 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSTNAGGGQKHRLTCPSCDSYEKKPPKEFLERFKSLLQKMIHQHLSSRTHGSEDS

SEQ ID NO: 1993 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSTNPGQRQKHRLTCPSCDSYEKKPPKEFLERFKSLLQKMIHQHLSSRTHGSEDS

SEQ ID NO: 1994 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRRQKDTLTCPSCDSYEKKPPKEFLERFKSLLQKMIHQHLSSRTHGSEDS

SEQ ID NO: 1995 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGQDQKHRLTCPSCDSYEKKPPKEFLERFKSLLQKMIHQHLSSRTHGSEDS

SEQ ID NO: 1996 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSTNAGGGQKHRLTCPSCDSYEKKPPKEFLERFKSLLQKMIHQHLSSRTHGSEDS

SEQ ID NO: 1997 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRDQKDRLTCPSCDSYEKKPPKEFLERFKSLLQKMIHQHLSSRTHGSEDS

SEQ ID NO: 1998 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGRRQKHTLECPSCDSYEKKPPKEFLERFKSLLQKMIHQHLSSRTHGSEDS

SEQ ID NO: 1999 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGRRQKDRLTCPSCDSYEKKPPKEFLERFKSLLQKMIHQHLSSRTHGSEDS

SEQ ID NO: 2000 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRGQKDRLTCPSCDSYEKKPPKEFLERFKSLLQKMIHQHLSSRTHGSEDS

SEQ ID NO: 2001 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRRQKDRLECPSCDSYEKKPPKEFLERFKSLLQKMIHQHLSSRTHGSEDS

SEQ ID NO: 2002 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSTNPGQRQKHRLTCPSCDSYEKKPPKEFLERFKSLLQKMIHQHLSSRTHGSEDS

SEQ ID NO: 2003 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGQGQKHRLTCPSCDSYEKKPPKEFLERFKSLLQKMIHQHLSSRTHGSEDS

SEQ ID NO: 2004 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSDNPGGRQKHRLTCPSCDSYEKKPPKEFLERFKSLLQKMIHQHLSSRTHGSEDS

SEQ ID NO: 2005 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSDNPGRGQKHRLTCPSCDSYEKKPPKEFLERFKSLLQKMIHQHLSSRTHGSEDS

SEQ ID NO: 2006 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINESIKKLKRKPPSTNPGRRQKHRLTCPSCDSYEKKPPKEFLERFKSLLQKMIHQHLSSRTHGSEDS

SEQ ID NO: 2007 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGRRQKDRLTCPSCDSYEKKPPKEFLERFKSLLQKMIHQHLSSRTHGSEDS

SEQ ID NO: 2008 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQDQKHRLTCPSCDSYEKKPPKEFLERFKSLLQKMIHQHLSSRTHGSEDS

SEQ ID NO: 2009 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSDNAGGRQKHRLTCPSCDSYEKKPPKEFLERFKSLLQKMIHQHLSSRTHGSEDS

SEQ ID NO: 2010 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNPGRGQKHRLTCPSCDSYEKKPPKEFLERFKSLLQKMIHQHLSSRTHGSEDS

SEQ ID NO: 2011 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGDQKHRLECPSCDSYEKKPPKEFLERFKSLLQKMIHQHLSSRTHGSEDS

SEQ ID NO: 2012 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSTNPGQRQKHRLTCPSCDSYEKKPPKEFLERFKSLLQKMIHQHLSSRTHGSEDS

SEQ ID NO: 2013 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRDQKHTLTCPSCDSYEKKPPKEFLERFKSLLQKMIHQHLSSRTHGSEDS

SEQ ID NO: 2014 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGQRQKDRLTCPSCDSYEKKPPKEFLERFKSLLQKMIHQHLSSRTHGSEDS

SEQ ID NO: 2015 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSTNAGQRQKHRLTCPSCDSYEKKPPKEFLERFKSLLQKMIHQHLSSRTHGSEDS

SEQ ID NO: 2016 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGQRQKDRLTCPSCDSYEKKPPKEFLERFKSLLQKMIHQHLSSRTHGSEDS

SEQ ID NO: 2017 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGQRQKHRLECPSCDSYEKKPPKEFLERFKSLLQKMIHQHLSSRTHGSEDS

SEQ ID NO: 2018 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRRQKDTLECPSCDSYEKKPPKEFLERFKSLLQKMIHQHLSSRTHGSEDS

SEQ ID NO: 2019 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSTNPGRGQKHRLTCPSCDSYEKKPPKEFLERFKSLLQKMIHQHLSSRTHGSEDS

SEQ ID NO: 2020 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNPGRGQKHRLTCPSCDSYEKKPPKEFLERFKSLLQKMIHQHLSSRTHGSEDS

SEQ ID NO: 2021 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGDQKHRLTCPSCDSYEKKPPKEFLERFKSLLQKMIHQHLSSRTHGSEDS

SEQ ID NO: 2022 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKPPSDNAGRGQKHRLTCPSCDSYEKKPPKEFLERFKSLLQKMIHQHLSSRTHGSEDS

SEQ ID NO: 2023 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGGRQKHRLTCPSCDSYEKKPPKEFLERFKSLLQKMIHQHLSSRTHGSEDS

SEQ ID NO: 2024 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKVPSTNAGRDQKHRLTCPSCDSYEKKPPKEFLERFKSLLQKMIHQHLSSRTHGSEDS

SEQ ID NO: 2025 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGRRQKDTLTCPSCDSYEKKPPKEFLERFKSLLQKMIHQHLSSRTHGSEDS

SEQ ID NO: 2026 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGRGQKHRLTCPSCDSYEKKPPKEFLERFKSLLQKMIHQHLSSRTHGSEDS

SEQ ID NO: 2027 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNPGGRQKHRLTCPSCDSYEKKPPKEFLERFKSLLQKMIHQHLSSRTHGSEDS

SEQ ID NO: 2028 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGGRQKDRLTCPSCDSYEKKPPKEFLERFKSLLQKMIHQHLSSRTHGSEDS

SEQ ID NO: 2029 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSTNAGGGQKHRLTCPSCDSYEKKPPKEFLERFKSLLQKMIHQHLSSRTHGSEDS

SEQ ID NO: 2030 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRGQKDRLECPSCDSYEKKPPKEFLERFKSLLQKMIHQHLSSRTHGSEDS

SEQ ID NO: 2031 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSDNAGRGQKHRLTCPSCDSYEKKPPKEFLERFKSLLQKMIHQHLSSRTHGSEDS

SEQ ID NO: 2032 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSTNAGRDQKHRLTCPSCDSYEKKPPKEFLERFKSLLQKMIHQHLSSRTHGSEDS

SEQ ID NO: 2033 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSTNPGRDQKHRLTCPSCDSYEKKPPKEFLERFKSLLQKMIHQHLSSRTHGSEDS

SEQ ID NO: 2034 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGQRQKDTLTCPSCDSYEKKPPKEFLERFKSLLQKMIHQHLSSRTHGSEDS

SEQ ID NO: 2035 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINESIKKLKRKVPSTNAGRRQKHRLTCPSCDSYEKKPPKEFLERFKSLLQKMIHQHLSSRTHGSEDS

SEQ ID NO: 2036 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGQRQKHRLTCPSCDSYEKKPPKEFLERFKSLLQKMIHQHLSSRTHGSEDS

SEQ ID NO: 2037 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGGRQKHRLECPSCDSYEKKPPKEFLERFKSLLQKMIHQHLSSRTHGSEDS

SEQ ID NO: 2038 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGGRQKDRLTCPSCDSYEKKPPKEFLERFKSLLQKMIHQHLSSRTHGSEDS

SEQ ID NO: 2039 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGQRQKHRLTCPSCDSYEKKPPKEFLERFKSLLQKMIHQHLSSRTHGSEDS

SEQ ID NO: 2040 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKVPSDNAGRRQKHRLTCPSCDSYEKKPPKEFLERFKSLLQKMIHQHLSSRTHGSEDS

SEQ ID NO: 2041 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSTNAGRGQKHRLTCPSCDSYEKKPPKEFLERFKSLLQKMIHQHLSSRTHGSEDS

SEQ ID NO: 2042 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNAGRRQKHRLECPSCDSYEKKPPKEFLERFKSLLQKMIHQHLSSRTHGSEDS

SEQ ID NO: 2043 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINESIKKLKRKPPSTNAGRRQKHRLTCPSCDSYEKKPPKEFLERFKSLLQKMIHQHLSSRTHGSEDS

SEQ ID NO: 2044 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKPPSDNAGQRQKHRLTCPSCDSYEKKPPKEFLERFKSLLQKMIHQHLSSRTHGSEDS

SEQ ID NO: 2045 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGRQKDRLECPSCDSYEKKPPKEFLERFKSLLQKMIHQHLSSRTHGSEDS

SEQ ID NO: 2046 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSTNPGGDQKHRLTCPSCDSYEKKPPKEFLERFKSLLQKMIHQHLSSRTHGSEDS

SEQ ID NO: 2047 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGRGQKHRLECPSCDSYEKKPPKEFLERFKSLLQKMIHQHLSSRTHGSEDS

SEQ ID NO: 2048 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSTNAGQRQKHRLTCPSCDSYEKKPPKEFLERFKSLLQKMIHQHLSSRTHGSEDS

SEQ ID NO: 2049 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGRDQKHRLECPSCDSYEKKPPKEFLERFKSLLQKMIHQHLSSRTHGSEDS

SEQ ID NO: 2050 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSDNAGQRQKHRLTCPSCDSYEKKPPKEFLERFKSLLQKMIHQHLSSRTHGSEDS

SEQ ID NO: 2051 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSDNAGGGQKHRLTCPSCDSYEKKPPKEFLERFKSLLQKMIHQHLSSRTHGSEDS

SEQ ID NO: 2052 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGGQKDRLTCPSCDSYEKKPPKEFLERFKSLLQKMIHQHLSSRTHGSEDS

SEQ ID NO: 2053 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKVPSTNAGQRQKHRLTCPSCDSYEKKPPKEFLERFKSLLQKMIHQHLSSRTHGSEDS

SEQ ID NO: 2054 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGQRQKHTLECPSCDSYEKKPPKEFLERFKSLLQKMIHQHLSSRTHGSEDS

SEQ ID NO: 2055 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSTNAGGRQKHRLTCPSCDSYEKKPPKEFLERFKSLLQKMIHQHLSSRTHGSEDS

SEQ ID NO: 2056 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSTNPGQRQKHRLTCPSCDSYEKKPPKEFLERFKSLLQKMIHQHLSSRTHGSEDS

SEQ ID NO: 2057 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKPPSTNAGRDQKHRLTCPSCDSYEKKPPKEFLERFKSLLQKMIHQHLSSRTHGSEDS

SEQ ID NO: 2058 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGRRQKDTLTCPSCDSYEKKPPKEFLERFKSLLQKMIHQHLSSRTHGSEDS

SEQ ID NO: 2059 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKVPSTNAGGRQKHRLTCPSCDSYEKKPPKEFLERFKSLLQKMIHQHLSSRTHGSEDS

SEQ ID NO: 2060 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKVPSTNAGQRQKHRLTCPSCDSYEKKPPKEFLERFKSLLQKMIHQHLSSRTHGSEDS

SEQ ID NO: 2061 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGQRQKHTLTCPSCDSYEKKPPKEFLERFKSLLQKMIHQHLSSRTHGSEDS

SEQ ID NO: 2062 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGGRQKHTLTCPSCDSYEKKPPKEFLERFKSLLQKMIHQHLSSRTHGSEDS

SEQ ID NO: 2063 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINESIKKLKRKVPSTNAGRRQKHRLTCPSCDSYEKKPPKEFLERFKSLLQKMIHQHLSSRTHGSEDS

SEQ ID NO: 2064 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSTNPGRDQKHRLTCPSCDSYEKKPPKEFLERFKSLLQKMIHQHLSSRTHGSEDS

SEQ ID NO: 2065 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKPPSTNPGRRQKHRLTCPSCDSYEKKPPKEFLERFKSLLQKMIHQHLSSRTHGSEDS

SEQ ID NO: 2066 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRDQKHRLTCPSCDSYEKKPPKEFLERFKSLLQKMIHQHLSSRTHGSEDS

SEQ ID NO: 2067 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINESIKKLKRKVPSTNAGRRQKHRLTCPSCDSYEKKPPKEFLERFKSLLQKMIHQHLSSRTHGSEDS

SEQ ID NO: 2068 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGRGQKHRLECPSCDSYEKKPPKEFLERFKSLLQKMIHQHLSSRTHGSEDS

SEQ ID NO: 2069 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGGRQKHTLTCPSCDSYEKKPPKEFLERFKSLLQKMIHQHLSSRTHGSEDS

SEQ ID NO: 2070 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNAGGRQKHRLTCPSCDSYEKKPPKEFLERFKSLLQKMIHQHLSSRTHGSEDS

SEQ ID NO: 2071 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKDTLECPSCDSYEKKPPKEFLERFKSLLQKMIHQHLSSRTHGSEDS

SEQ ID NO: 2072 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGGGQKHRLTCPSCDSYEKKPPKEFLERFKSLLQKMIHQHLSSRTHGSEDS

SEQ ID NO: 2073 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNAGRGQKHRLTCPSCDSYEKKPPKEFLERFKSLLQKMIHQHLSSRTHGSEDS

SEQ ID NO: 2074 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGQRQKHTLTCPSCDSYEKKPPKEFLERFKSLLQKMIHQHLSSRTHGSEDS

SEQ ID NO: 2075 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSDNAGRRQKHRLECPSCDSYEKKPPKEFLERFKSLLQKMIHQHLSSRTHGSEDS

SEQ ID NO: 2076 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGRGQKHRLECPSCDSYEKKPPKEFLERFKSLLQKMIHQHLSSRTHGSEDS

SEQ ID NO: 2077 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGQRQKHTLTCPSCDSYEKKPPKEFLERFKSLLQKMIHQHLSSRTHGSEDS

SEQ ID NO: 2078 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGGRQKHTLTCPSCDSYEKKPPKEFLERFKSLLQKMIHQHLSSRTHGSEDS

SEQ ID NO: 2079 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINVSIKKLKRKPPSTNPGRRQKHRLTCPSCDSYEKKPPKEFLERFKSLLQKMIHQHLSSRTHGSEDS

SEQ ID NO: 2080 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRGQKHTLTCPSCDSYEKKPPKEFLERFKSLLQKMIHQHLSSRTHGSEDS

SEQ ID NO: 2081 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSTNAGRGQKHRLTCPSCDSYEKKPPKEFLERFKSLLQKMIHQHLSSRTHGSEDS

SEQ ID NO: 2082 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNPGRRQKDRLTCPSCDSYEKKPPKEFLERFKSLLQKMIHQHLSSRTHGSEDS

SEQ ID NO: 2083 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSDNAGRRQKHTLTCPSCDSYEKKPPKEFLERFKSLLQKMIHQHLSSRTHGSEDS

SEQ ID NO: 2084 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSTNAGRGQKHRLTCPSCDSYEKKPPKEFLERFKSLLQKMIHQHLSSRTHGSEDS

SEQ ID NO: 2085 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGRGQKHRLTCPSCDSYEKKPPKEFLERFKSLLQKMIHQHLSSRTHGSEDS

SEQ ID NO: 2086 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGRGQKHTLTCPSCDSYEKKPPKEFLERFKSLLQKMIHQHLSSRTHGSEDS

SEQ ID NO: 2087 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSDNAGGRQKHRLTCPSCDSYEKKPPKEFLERFKSLLQKMIHQHLSSRTHGSEDS

SEQ ID NO: 2088 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSTNPGRGQKHRLTCPSCDSYEKKPPKEFLERFKSLLQKMIHQHLSSRTHGSEDS

SEQ ID NO: 2089 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINESIKKLKRKVPSTNAGRRQKHRLTCPSCDSYEKKPPKEFLERFKSLLQKMIHQHLSSRTHGSEDS

SEQ ID NO: 2090 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGGRQKHTLTCPSCDSYEKKPPKEFLERFKSLLQKMIHQHLSSRTHGSEDS

SEQ ID NO: 2091 - protein, 162 aa, synthetic construct
MRSSPGNMERIVICLMVIFLGTLVHKSSSQGQDRIMIRMRQLIDTVDQLKNYVNDLVPEFLPAPEDVETGCEWSAFSCFQKAQLKSANTGNNERIINVSIKKLKRKPPSTNAGGRQKHRLTCPSCDSYEKKPPKEFLERFKSLLQKMIHQHLSSRTHGSEDS

SEQ ID NO: 2092 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGQRQKDRLECPSCDSYEKKPPKEFLERFKSLLQKMIHQHLSSRTHGSEDS

SEQ ID NO: 2093 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSTNAGGDQKHRLTCPSCDSYEKKPPKEFLERFKSLLQKMIHQHLSSRTHGSEDS

SEQ ID NO: 2094 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQGQKHTLTCPSCDSYEKKPPKEFLERFKSLLQKMIHQHLSSRTHGSEDS

SEQ ID NO: 2095 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGRGQKHTLTCPSCDSYEKKPPKEFLERFKSLLQKMIHQHLSSRTHGSEDS

SEQ ID NO: 2096 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRGQKDRLTCPSCDSYEKKPPKEFLERFKSLLQKMIHQHLSSRTHGSEDS

SEQ ID NO: 2097 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSTNPGGRQKHRLTCPSCDSYEKKPPKEFLERFKSLLQKMIHQHLSSRTHGSEDS

SEQ ID NO: 2098 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRGQKHRLTCPSCDSYEKKPPKEFLERFKSLLQKMIHQHLSSRTHGSEDS

SEQ ID NO: 2099 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGRQKDTLTCPSCDSYEKKPPKEFLERFKSLLQKMIHQHLSSRTHGSEDS

SEQ ID NO: 2100 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNPGRRQKHTLTCPSCDSYEKKPPKEFLERFKSLLQKMIHQHLSSRTHGSEDS

SEQ ID NO: 2101 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGGRQKHTLECPSCDSYEKKPPKEFLERFKSLLQKMIHQHLSSRTHGSEDS

SEQ ID NO: 2102 - protein, 162 aa, synthetic construct
MRSSPGNMERIVICLMVIFLGTLVHKSSSQGQDRFMIRMRQLIDTVDQLKNYVNDLVPEFLPAPEDVETGCEWSAFSCFQKAQLKSANTGNNERIINVSIKKLKRKPPSTNAGQRQKHRLTCPSCDSYEKKPPKEFLERFKSLLQKMIHQHLSSRTHGSEDS

SEQ ID NO: 2103 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINESIKKLKRKPPSTNPGRRQKHRLTCPSCDSYEKKPPKEFLERFKSLLQKMIHQHLSSRTHGSEDS

SEQ ID NO: 2104 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGGRQKHTLTCPSCDSYEKKPPKEFLERFKSLLQKMIHQHLSSRTHGSEDS

SEQ ID NO: 2105 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGQGQKHRLECPSCDSYEKKPPKEFLERFKSLLQKMIHQHLSSRTHGSEDS

SEQ ID NO: 2106 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGGRQKHRLTCPSCDSYEKKPPKEFLERFKSLLQKMIHQHLSSRTHGSEDS

SEQ ID NO: 2107 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGGRQKDRLTCPSCDSYEKKPPKEFLERFKSLLQKMIHQHLSSRTHGSEDS

SEQ ID NO: 2108 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGQRQKHTLTCPSCDSYEKKPPKEFLERFKSLLQKMIHQHLSSRTHGSEDS

SEQ ID NO: 2109 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRDQKHRLECPSCDSYEKKPPKEFLERFKSLLQKMIHQHLSSRTHGSEDS

SEQ ID NO: 2110 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGGGQKHRLTCPSCDSYEKKPPKEFLERFKSLLQKMIHQHLSSRTHGSEDS

SEQ ID NO: 2111 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRGQKHTLECPSCDSYEKKPPKEFLERFKSLLQKMIHQHLSSRTHGSEDS

SEQ ID NO: 2112 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGQGQKHRLTCPSCDSYEKKPPKEFLERFKSLLQKMIHQHLSSRTHGSEDS

SEQ ID NO: 2113 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRGQKHTLECPSCDSYEKKPPKEFLERFKSLLQKMIHQHLSSRTHGSEDS

SEQ ID NO: 2114 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSDNPGQRQKHRLTCPSCDSYEKKPPKEFLERFKSLLQKMIHQHLSSRTHGSEDS

SEQ ID NO: 2115 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSTNPGQRQKHRLTCPSCDSYEKKPPKEFLERFKSLLQKMIHQHLSSRTHGSEDS

SEQ ID NO: 2116 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGQRQKHTLTCPSCDSYEKKPPKEFLERFKSLLQKMIHQHLSSRTHGSEDS

SEQ ID NO: 2117 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKPPSTNAGRGQKHRLTCPSCDSYEKKPPKEFLERFKSLLQKMIHQHLSSRTHGSEDS

SEQ ID NO: 2118 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQDAQLKSANTGNNERIINVSIKKLKRKVPSTNAGRRQKHRLTCPSCDSYEKKPPKEFLERFKSLLQKMIHQHLSSRTHGSEDS

SEQ ID NO: 2119 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSTNAGQRQKHRLTCPSCDSYEKKPPKEFLERFKSLLQKMIHQHLSSRTHGSEDS

SEQ ID NO: 2120 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGRRQKHRLECPSCDSYEKKPPKEFLERFKSLLQKMIHQHLSSRTHGSEDS

SEQ ID NO: 2121 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSDNAGRGQKHRLTCPSCDSYEKKPPKEFLERFKSLLQKMIHQHLSSRTHGSEDS

SEQ ID NO: 2122 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGQGQKHTLTCPSCDSYEKKPPKEFLERFKSLLQKMIHQHLSSRTHGSEDS

SEQ ID NO: 2123 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSTNPGRDQKHRLTCPSCDSYEKKPPKEFLERFKSLLQKMIHQHLSSRTHGSEDS

SEQ ID NO: 2124 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINESIKKLKRKPPSTNAGRRQKHRLTCPSCDSYEKKPPKEFLERFKSLLQKMIHQHLSSRTHGSEDS

SEQ ID NO: 2125 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGGRQKDRLTCPSCDSYEKKPPKEFLERFKSLLQKMIHQHLSSRTHGSEDS

SEQ ID NO: 2126 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGQRQKHRLTCPSCDSYEKKPPKEFLERFKSLLQKMIHQHLSSRTHGSEDS

SEQ ID NO: 2127 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSTNAGQGQKHRLTCPSCDSYEKKPPKEFLERFKSLLQKMIHQHLSSRTHGSEDS

SEQ ID NO: 2128 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNPGRGQKHRLTCPSCDSYEKKPPKEFLERFKSLLQKMIHQHLSSRTHGSEDS

SEQ ID NO: 2129 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQRQKHTLECPSCDSYEKKPPKEFLERFKSLLQKMIHQHLSSRTHGSEDS

SEQ ID NO: 2130 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINESIKKLKRKVPSTNPGRRQKHRLTCPSCDSYEKKPPKEFLERFKSLLQKMIHQHLSSRTHGSEDS

SEQ ID NO: 2131 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKVPSTNPGRRQKHRLTCPSCDSYEKKPPKEFLERFKSLLQKMIHQHLSSRTHGSEDS

SEQ ID NO: 2132 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKVPSTNAGQRQKHRLTCPSCDSYEKKPPKEFLERFKSLLQKMIHQHLSSRTHGSEDS

SEQ ID NO: 2133 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRGQKHTLTCPSCDSYEKKPPKEFLERFKSLLQKMIHQHLSSRTHGSEDS

SEQ ID NO: 2134 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRDQKHRLTCPSCDSYEKKPPKEFLERFKSLLQKMIHQHLSSRTHGSEDS

SEQ ID NO: 2135 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINESIKKLKRKPPSTNPGRRQKHRLTCPSCDSYEKKPPKEFLERFKSLLQKMIHQHLSSRTHGSEDS

SEQ ID NO: 2136 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGRRQKHTLTCPSCDSYEKKPPKEFLERFKSLLQKMIHQHLSSRTHGSEDS

SEQ ID NO: 2137 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSTNPGGGQKHRLTCPSCDSYEKKPPKEFLERFKSLLQKMIHQHLSSRTHGSEDS

SEQ ID NO: 2138 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGRGQKDRLTCPSCDSYEKKPPKEFLERFKSLLQKMIHQHLSSRTHGSEDS

SEQ ID NO: 2139 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNPGQRQKHRLTCPSCDSYEKKPPKEFLERFKSLLQKMIHQHLSSRTHGSEDS

SEQ ID NO: 2140 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSDNPGGRQKHRLTCPSCDSYEKKPPKEFLERFKSLLQKMIHQHLSSRTHGSEDS

SEQ ID NO: 2141 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSDNAGRRQKHRLTCPSCDSYEKKPPKEFLERFKSLLQKMIHQHLSSRTHGSEDS

SEQ ID NO: 2142 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQGQKHRLECPSCDSYEKKPPKEFLERFKSLLQKMIHQHLSSRTHGSEDS

SEQ ID NO: 2143 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRRQKHTLECPSCDSYEKKPPKEFLERFKSLLQKMIHQHLSSRTHGSEDS

SEQ ID NO: 2144 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQGQKHRLTCPSCDSYEKKPPKEFLERFKSLLQKMIHQHLSSRTHGSEDS

SEQ ID NO: 2145 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKPPSTNAGGGQKHRLTCPSCDSYEKKPPKEFLERFKSLLQKMIHQHLSSRTHGSEDS

SEQ ID NO: 2146 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNPGGRQKHRLTCPSCDSYEKKPPKEFLERFKSLLQKMIHQHLSSRTHGSEDS

SEQ ID NO: 2147 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRGQKHRLECPSCDSYEKKPPKEFLERFKSLLQKMIHQHLSSRTHGSEDS

SEQ ID NO: 2148 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSDNAGRRQKHRLTCPSCDSYEKKPPKEFLERFKSLLQKMIHQHLSSRTHGSEDS

SEQ ID NO: 2149 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGGRQKDRLTCPSCDSYEKKPPKEFLERFKSLLQKMIHQHLSSRTHGSEDS

SEQ ID NO: 2150 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSDNAGQRQKHRLTCPSCDSYEKKPPKEFLERFKSLLQKMIHQHLSSRTHGSEDS

SEQ ID NO: 2151 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNPGGRQKHRLTCPSCDSYEKKPPKEFLERFKSLLQKMIHQHLSSRTHGSEDS

SEQ ID NO: 2152 - protein, 162 aa, synthetic construct
MRSSPGNMERIVICLMVIFLGTLVHKSSSQGQDRFMIRMRQLIDTVDQLKNYVNDLVPEFLPAPEDVETGCEWSAFSCFQKAQLKSANTGNNERIINVSIKKLKRKPPSTNAGRGQKHRLTCPSCDSYEKKPPKEFLERFKSLLQKMIHQHLSSRTHGSEDS

SEQ ID NO: 2153 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGGRQKHRLTCPSCDSYEKKPPKEFLERFKSLLQKMIHQHLSSRTHGSEDS

SEQ ID NO: 2154 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGGQKHTLTCPSCDSYEKKPPKEFLERFKSLLQKMIHQHLSSRTHGSEDS

SEQ ID NO: 2155 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGGQKHRLTCPSCDSYEKKPPKEFLERFKSLLQKMIHQHLSSRTHGSEDS

SEQ ID NO: 2156 - protein, 162 aa, synthetic construct
MRSSPGNMERIVICLMVIFLGTLVHKSSSQGQDRIMIRMRQLIDTVDQLKNYVNDLVPEFLPAPEDVETGCEWSAFSCFQKAQLKSANTGNNERIINVSIKKLKRKPPSTNAGQRQKHRLTCPSCDSYEKKPPKEFLERFKSLLQKMIHQHLSSRTHGSEDS

SEQ ID NO: 2157 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNPGQRQKHRLTCPSCDSYEKKPPKEFLERFKSLLQKMIHQHLSSRTHGSEDS

SEQ ID NO: 2158 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGRRQKHTLECPSCDSYEKKPPKEFLERFKSLLQKMIHQHLSSRTHGSEDS

SEQ ID NO: 2159 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSTNAGGRQKHRLTCPSCDSYEKKPPKEFLERFKSLLQKMIHQHLSSRTHGSEDS

SEQ ID NO: 2160 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRGQKHRLECPSCDSYEKKPPKEFLERFKSLLQKMIHQHLSSRTHGSEDS

SEQ ID NO: 2161 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSTNAGRGQKHRLTCPSCDSYEKKPPKEFLERFKSLLQKMIHQHLSSRTHGSEDS

SEQ ID NO: 2162 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKVPSTNAGGRQKHRLTCPSCDSYEKKPPKEFLERFKSLLQKMIHQHLSSRTHGSEDS

SEQ ID NO: 2163 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2164 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKPPSTNPGGRQKHRLTCPSCDSYEKKPPKEFLERFKSLLQKMIHQHLSSRTHGSEDS

SEQ ID NO: 2165 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGRRQKDRLTCPSCDSYEKKPPKEFLERFKSLLQKMIHQHLSSRTHGSEDS

SEQ ID NO: 2166 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSDNAGRRQKHRLTCPSCDSYEKKPPKEFLERFKSLLQKMIHQHLSSRTHGSEDS

SEQ ID NO: 2167 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGGGQKHRLECPSCDSYEKKPPKEFLERFKSLLQKMIHQHLSSRTHGSEDS

SEQ ID NO: 2168 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSDNPGQRQKHRLTCPSCDSYEKKPPKEFLERFKSLLQKMIHQHLSSRTHGSEDS

SEQ ID NO: 2169 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNPGRRQKHTLTCPSCDSYEKKPPKEFLERFKSLLQKMIHQHLSSRTHGSEDS

SEQ ID NO: 2170 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSDNPGRRQKHRLTCPSCDSYEKKPPKEFLERFKSLLQKMIHQHLSSRTHGSEDS

SEQ ID NO: 2171 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSDNAGRRQKHRLTCPSCDSYEKKPPKEFLERFKSLLQKMIHQHLSSRTHGSEDS

SEQ ID NO: 2172 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKVPSTNAGRRQKHRLTCPSCDSYEKKPPKEFLERFKSLLQKMIHQHLSSRTHGSEDS

SEQ ID NO: 2173 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGQRQKHRLECPSCDSYEKKPPKEFLERFKSLLQKMIHQHLSSRTHGSEDS

SEQ ID NO: 2174 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSDNAGRGQKHRLTCPSCDSYEKKPPKEFLERFKSLLQKMIHQHLSSRTHGSEDS

SEQ ID NO: 2175 - protein, 162 aa, synthetic construct
MRSSPGNMERIVICLMVIFLGTLVHKSSSQGQDRIMIRMRQLIDTVDQLKNYVNDLVPEFLPAPEDVETGCEWSAFSCFQKAQLKSANTGNNERIINVSIKKLKRKPPSDNAGRRQKHRLTCPSCDSYEKKPPKEFLERFKSLLQKMIHQHLSSRTHGSEDS

SEQ ID NO: 2176 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSDNAGRRQKHRLTCPSCDSYEKKPPKEFLERFKSLLQKMIHQHLSSRTHGSEDS

SEQ ID NO: 2177 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGQRQKHTLTCPSCDSYEKKPPKEFLERFKSLLQKMIHQHLSSRTHGSEDS

SEQ ID NO: 2178 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGGRQKHRLECPSCDSYEKKPPKEFLERFKSLLQKMIHQHLSSRTHGSEDS

SEQ ID NO: 2179 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSTNPGRGQKHRLTCPSCDSYEKKPPKEFLERFKSLLQKMIHQHLSSRTHGSEDS

SEQ ID NO: 2180 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKVPSTNAGGRQKHRLTCPSCDSYEKKPPKEFLERFKSLLQKMIHQHLSSRTHGSEDS

SEQ ID NO: 2181 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGRRQKHRLTCPSCDSYEKKPPKEFLERFKSLLQKMIHQHLSSRTHGSEDS

SEQ ID NO: 2182 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGRRQKDRLECPSCDSYEKKPPKEFLERFKSLLQKMIHQHLSSRTHGSEDS

SEQ ID NO: 2183 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGQRQKHRLECPSCDSYEKKPPKEFLERFKSLLQKMIHQHLSSRTHGSEDS

SEQ ID NO: 2184 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKVPSTNAGRRQKHRLTCPSCDSYEKKPPKEFLERFKSLLQKMIHQHLSSRTHGSEDS

SEQ ID NO: 2185 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRRQKDRLECPSCDSYEKKPPKEFLERFKSLLQKMIHQHLSSRTHGSEDS

SEQ ID NO: 2186 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGGRQKHRLTCPSCDSYEKKPPKEFLERFKSLLQKMIHQHLSSRTHGSEDS

SEQ ID NO: 2187 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRGQKHTLTCPSCDSYEKKPPKEFLERFKSLLQKMIHQHLSSRTHGSEDS

SEQ ID NO: 2188 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSTNPGGGQKHRLTCPSCDSYEKKPPKEFLERFKSLLQKMIHQHLSSRTHGSEDS

SEQ ID NO: 2189 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSTNPGGRQKHRLTCPSCDSYEKKPPKEFLERFKSLLQKMIHQHLSSRTHGSEDS

SEQ ID NO: 2190 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNAGQRQKHRLTCPSCDSYEKKPPKEFLERFKSLLQKMIHQHLSSRTHGSEDS

SEQ ID NO: 2191 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRDQKHTLTCPSCDSYEKKPPKEFLERFKSLLQKMIHQHLSSRTHGSEDS

SEQ ID NO: 2192 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2193 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGRGQKHRLECPSCDSYEKKPPKEFLERFKSLLQKMIHQHLSSRTHGSEDS

SEQ ID NO: 2194 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSDNPGRGQKHRLTCPSCDSYEKKPPKEFLERFKSLLQKMIHQHLSSRTHGSEDS

SEQ ID NO: 2195 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNAGRRQKHTLTCPSCDSYEKKPPKEFLERFKSLLQKMIHQHLSSRTHGSEDS

SEQ ID NO: 2196 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSTNAGRDQKHRLTCPSCDSYEKKPPKEFLERFKSLLQKMIHQHLSSRTHGSEDS

SEQ ID NO: 2197 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGQRQKHTLECPSCDSYEKKPPKEFLERFKSLLQKMIHQHLSSRTHGSEDS

SEQ ID NO: 2198 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGRQKDRLTCPSCDSYEKKPPKEFLERFKSLLQKMIHQHLSSRTHGSEDS

SEQ ID NO: 2199 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRRQKHTLECPSCDSYEKKPPKEFLERFKSLLQKMIHQHLSSRTHGSEDS

SEQ ID NO: 2200 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSTNPGGRQKHRLTCPSCDSYEKKPPKEFLERFKSLLQKMIHQHLSSRTHGSEDS

SEQ ID NO: 2201 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSDNAGGRQKHRLTCPSCDSYEKKPPKEFLERFKSLLQKMIHQHLSSRTHGSEDS

SEQ ID NO: 2202 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSTNAGQGQKHRLTCPSCDSYEKKPPKEFLERFKSLLQKMIHQHLSSRTHGSEDS

SEQ ID NO: 2203 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKVPSTNAGQRQKHRLTCPSCDSYEKKPPKEFLERFKSLLQKMIHQHLSSRTHGSEDS

SEQ ID NO: 2204 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSTNPGQGQKHRLTCPSCDSYEKKPPKEFLERFKSLLQKMIHQHLSSRTHGSEDS

SEQ ID NO: 2205 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSDNAGRGQKHRLTCPSCDSYEKKPPKEFLERFKSLLQKMIHQHLSSRTHGSEDS

SEQ ID NO: 2206 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSDNPGGRQKHRLTCPSCDSYEKKPPKEFLERFKSLLQKMIHQHLSSRTHGSEDS

SEQ ID NO: 2207 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRGQKDRLTCPSCDSYEKKPPKEFLERFKSLLQKMIHQHLSSRTHGSEDS

SEQ ID NO: 2208 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGQRQKHRLTCPSCDSYEKKPPKEFLERFKSLLQKMIHQHLSSRTHGSEDS

SEQ ID NO: 2209 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKVPSTNAGRGQKHRLTCPSCDSYEKKPPKEFLERFKSLLQKMIHQHLSSRTHGSEDS

SEQ ID NO: 2210 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKPPSDNAGRDQKHRLTCPSCDSYEKKPPKEFLERFKSLLQKMIHQHLSSRTHGSEDS

SEQ ID NO: 2211 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSDNAGGRQKHRLTCPSCDSYEKKPPKEFLERFKSLLQKMIHQHLSSRTHGSEDS

SEQ ID NO: 2212 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGGGQKHRLTCPSCDSYEKKPPKEFLERFKSLLQKMIHQHLSSRTHGSEDS

SEQ ID NO: 2213 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGGRQKHRLECPSCDSYEKKPPKEFLERFKSLLQKMIHQHLSSRTHGSEDS

SEQ ID NO: 2214 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRDQKHRLTCPSCDSYEKKPPKEFLERFKSLLQKMIHQHLSSRTHGSEDS

SEQ ID NO: 2215 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGQRQKHRLECPSCDSYEKKPPKEFLERFKSLLQKMIHQHLSSRTHGSEDS

SEQ ID NO: 2216 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSTNPGQRQKHRLTCPSCDSYEKKPPKEFLERFKSLLQKMIHQHLSSRTHGSEDS

SEQ ID NO: 2217 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKDRLECPSCDSYEKKPPKEFLERFKSLLQKMIHQHLSSRTHGSEDS

SEQ ID NO: 2218 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRGQKHRLTCPSCDSYEKKPPKEFLERFKSLLQKMIHQHLSSRTHGSEDS

SEQ ID NO: 2219 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSTNAGQRQKHRLTCPSCDSYEKKPPKEFLERFKSLLQKMIHQHLSSRTHGSEDS

SEQ ID NO: 2220 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGGRQKHRLTCPSCDSYEKKPPKEFLERFKSLLQKMIHQHLSSRTHGSEDS

SEQ ID NO: 2221 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSTNAGRDQKHRLTCPSCDSYEKKPPKEFLERFKSLLQKMIHQHLSSRTHGSEDS

SEQ ID NO: 2222 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGQRQKHRLECPSCDSYEKKPPKEFLERFKSLLQKMIHQHLSSRTHGSEDS

SEQ ID NO: 2223 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNPGGRQKHRLTCPSCDSYEKKPPKEFLERFKSLLQKMIHQHLSSRTHGSEDS

SEQ ID NO: 2224 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGGRQKHRLECPSCDSYEKKPPKEFLERFKSLLQKMIHQHLSSRTHGSEDS

SEQ ID NO: 2225 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSDNAGRRQKHRLTCPSCDSYEKKPPKEFLERFKSLLQKMIHQHLSSRTHGSEDS

SEQ ID NO: 2226 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGRRQKHTLECPSCDSYEKKPPKEFLERFKSLLQKMIHQHLSSRTHGSEDS

SEQ ID NO: 2227 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSTNPGQRQKHRLTCPSCDSYEKKPPKEFLERFKSLLQKMIHQHLSSRTHGSEDS

SEQ ID NO: 2228 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNPGRRQKHTLTCPSCDSYEKKPPKEFLERFKSLLQKMIHQHLSSRTHGSEDS

SEQ ID NO: 2229 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNPGQRQKHRLTCPSCDSYEKKPPKEFLERFKSLLQKMIHQHLSSRTHGSEDS

SEQ ID NO: 2230 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGRQKHTLECPSCDSYEKKPPKEFLERFKSLLQKMIHQHLSSRTHGSEDS

SEQ ID NO: 2231 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRGQKHRLECPSCDSYEKKPPKEFLERFKSLLQKMIHQHLSSRTHGSEDS

SEQ ID NO: 2232 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNPGRRQKHRLECPSCDSYEKKPPKEFLERFKSLLQKMIHQHLSSRTHGSEDS

SEQ ID NO: 2233 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRRQKDTLTCPSCDSYEKKPPKEFLERFKSLLQKMIHQHLSSRTHGSEDS

SEQ ID NO: 2234 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSTNAGGRQKHRLTCPSCDSYEKKPPKEFLERFKSLLQKMIHQHLSSRTHGSEDS

SEQ ID NO: 2235 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKPPSTNAGQRQKHRLTCPSCDSYEKKPPKEFLERFKSLLQKMIHQHLSSRTHGSEDS

SEQ ID NO: 2236 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRRQKDRLTCPSCDSYEKKPPKEFLERFKSLLQKMIHQHLSSRTHGSEDS

SEQ ID NO: 2237 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGRGQKHRLTCPSCDSYEKKPPKEFLERFKSLLQKMIHQHLSSRTHGSEDS

SEQ ID NO: 2238 - protein, 162 aa, synthetic construct; identical to SEQ ID NO: 547

SEQ ID NO: 2239 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKVPSDNAGRRQKHRLTCPSCDSYEKKPPKEFLERFKSLLQKMIHQHLSSRTHGSEDS

SEQ ID NO: 2240 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGRRQKHTLECPSCDSYEKKPPKEFLERFKSLLQKMIHQHLSSRTHGSEDS

SEQ ID NO: 2241 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2242 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGRRQKHRLECPSCDSYEKKPPKEFLERFKSLLQKMIHQHLSSRTHGSEDS

SEQ ID NO: 2243 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGGQKHRLECPSCDSYEKKPPKEFLERFKSLLQKMIHQHLSSRTHGSEDS

SEQ ID NO: 2244 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSTNPGRRQKHRLTCPSCDSYEKKPPKEFLERFKSLLQKMIHQHLSSRTHGSEDS

SEQ ID NO: 2245 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRGQKHRLTCPSCDSYEKKPPKEFLERFKSLLQKMIHQHLSSRTHGSEDS

SEQ ID NO: 2246 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGRRQKHTLTCPSCDSYEKKPPKEFLERFKSLLQKMIHQHLSSRTHGSEDS

SEQ ID NO: 2247 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRGQKHTLTCPSCDSYEKKPPKEFLERFKSLLQKMIHQHLSSRTHGSEDS

SEQ ID NO: 2248 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGGRQKHRLECPSCDSYEKKPPKEFLERFKSLLQKMIHQHLSSRTHGSEDS

SEQ ID NO: 2249 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSTNPGRRQKHRLTCPSCDSYEKKPPKEFLERFKSLLQKMIHQHLSSRTHGSEDS

SEQ ID NO: 2250 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGGRQKHRLTCPSCDSYEKKPPKEFLERFKSLLQKMIHQHLSSRTHGSEDS

SEQ ID NO: 2251 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGQRQKHRLECPSCDSYEKKPPKEFLERFKSLLQKMIHQHLSSRTHGSEDS

SEQ ID NO: 2252 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKPPSTNPGQRQKHRLTCPSCDSYEKKPPKEFLERFKSLLQKMIHQHLSSRTHGSEDS

SEQ ID NO: 2253 - protein, 162 aa, synthetic construct
MRSSPGNMERIVICLMVIFLGTLVHKSSSQGQDRFMIRMRQLIDTVDQLKNYVNDLVPEFLPAPEDVETGCEWSAFSCFQKAQLKSANTGNNERIINVSIKKLKRKPPSDNAGRRQKHRLTCPSCDSYEKKPPKEFLERFKSLLQKMIHQHLSSRTHGSEDS

SEQ ID NO: 2254 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKPPSTNPGRGQKHRLTCPSCDSYEKKPPKEFLERFKSLLQKMIHQHLSSRTHGSEDS

SEQ ID NO: 2255 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSDNPGRRQKHRLTCPSCDSYEKKPPKEFLERFKSLLQKMIHQHLSSRTHGSEDS

SEQ ID NO: 2256 - protein, 162 aa, synthetic construct; identical to SEQ ID NO: 535

SEQ ID NO: 2257 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKVPSTNAGRGQKHRLTCPSCDSYEKKPPKEFLERFKSLLQKMIHQHLSSRTHGSEDS

SEQ ID NO: 2258 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGRRQKHRLECPSCDSYEKKPPKEFLERFKSLLQKMIHQHLSSRTHGSEDS

SEQ ID NO: 2259 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSTNAGGRQKHRLTCPSCDSYEKKPPKEFLERFKSLLQKMIHQHLSSRTHGSEDS

SEQ ID NO: 2260 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGQRQKHRLTCPSCDSYEKKPPKEFLERFKSLLQKMIHQHLSSRTHGSEDS

SEQ ID NO: 2261 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRRQKDRLTCPSCDSYEKKPPKEFLERFKSLLQKMIHQHLSSRTHGSEDS

SEQ ID NO: 2262 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQRQKDRLTCPSCDSYEKKPPKEFLERFKSLLQKMIHQHLSSRTHGSEDS

SEQ ID NO: 2263 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSTNPGRGQKHRLTCPSCDSYEKKPPKEFLERFKSLLQKMIHQHLSSRTHGSEDS

SEQ ID NO: 2264 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSTNPGGRQKHRLTCPSCDSYEKKPPKEFLERFKSLLQKMIHQHLSSRTHGSEDS

SEQ ID NO: 2265 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSTNPGGRQKHRLTCPSCDSYEKKPPKEFLERFKSLLQKMIHQHLSSRTHGSEDS

SEQ ID NO: 2266 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSTNAGGRQKHRLTCPSCDSYEKKPPKEFLERFKSLLQKMIHQHLSSRTHGSEDS

SEQ ID NO: 2267 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGGRQKHRLECPSCDSYEKKPPKEFLERFKSLLQKMIHQHLSSRTHGSEDS

SEQ ID NO: 2268 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGQRQKHRLECPSCDSYEKKPPKEFLERFKSLLQKMIHQHLSSRTHGSEDS

SEQ ID NO: 2269 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSTNPGQRQKHRLTCPSCDSYEKKPPKEFLERFKSLLQKMIHQHLSSRTHGSEDS

SEQ ID NO: 2270 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGQRQKHTLTCPSCDSYEKKPPKEFLERFKSLLQKMIHQHLSSRTHGSEDS

SEQ ID NO: 2271 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRRQKDRLTCPSCDSYEKKPPKEFLERFKSLLQKMIHQHLSSRTHGSEDS

SEQ ID NO: 2272 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNAGRRQKHRLTCPSCDSYEKKPPKEFLERFKSLLQKMIHQHLSSRTHGSEDS

SEQ ID NO: 2273 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKVPSTNPGRRQKHRLTCPSCDSYEKKPPKEFLERFKSLLQKMIHQHLSSRTHGSEDS

SEQ ID NO: 2274 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGQRQKHRLTCPSCDSYEKKPPKEFLERFKSLLQKMIHQHLSSRTHGSEDS

SEQ ID NO: 2275 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKVPSTNAGRGQKHRLTCPSCDSYEKKPPKEFLERFKSLLQKMIHQHLSSRTHGSEDS

SEQ ID NO: 2276 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNPGRRQKHRLECPSCDSYEKKPPKEFLERFKSLLQKMIHQHLSSRTHGSEDS

SEQ ID NO: 2277 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKVPSDNAGRRQKHRLTCPSCDSYEKKPPKEFLERFKSLLQKMIHQHLSSRTHGSEDS

SEQ ID NO: 2278 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGRGQKHRLTCPSCDSYEKKPPKEFLERFKSLLQKMIHQHLSSRTHGSEDS

SEQ ID NO: 2279 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGRRQKDRLTCPSCDSYEKKPPKEFLERFKSLLQKMIHQHLSSRTHGSEDS

SEQ ID NO: 2280 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSTNAGGGQKHRLTCPSCDSYEKKPPKEFLERFKSLLQKMIHQHLSSRTHGSEDS

SEQ ID NO: 2281 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGGRQKHRLTCPSCDSYEKKPPKEFLERFKSLLQKMIHQHLSSRTHGSEDS

SEQ ID NO: 2282 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGRRQKDRLTCPSCDSYEKKPPKEFLERFKSLLQKMIHQHLSSRTHGSEDS

SEQ ID NO: 2283 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKPPSTNAGGRQKHRLTCPSCDSYEKKPPKEFLERFKSLLQKMIHQHLSSRTHGSEDS

SEQ ID NO: 2284 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKVPSTNAGGRQKHRLTCPSCDSYEKKPPKEFLERFKSLLQKMIHQHLSSRTHGSEDS

SEQ ID NO: 2285 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSTNAGGRQKHRLTCPSCDSYEKKPPKEFLERFKSLLQKMIHQHLSSRTHGSEDS

SEQ ID NO: 2286 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGQRQKDRLTCPSCDSYEKKPPKEFLERFKSLLQKMIHQHLSSRTHGSEDS

SEQ ID NO: 2287 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSTNAGQRQKHRLTCPSCDSYEKKPPKEFLERFKSLLQKMIHQHLSSRTHGSEDS

SEQ ID NO: 2288 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQRQKHRLECPSCDSYEKKPPKEFLERFKSLLQKMIHQHLSSRTHGSEDS

SEQ ID NO: 2289 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGQRQKHRLTCPSCDSYEKKPPKEFLERFKSLLQKMIHQHLSSRTHGSEDS

SEQ ID NO: 2290 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSTNAGRGQKHRLTCPSCDSYEKKPPKEFLERFKSLLQKMIHQHLSSRTHGSEDS

SEQ ID NO: 2291 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSDNPGRRQKHRLTCPSCDSYEKKPPKEFLERFKSLLQKMIHQHLSSRTHGSEDS

SEQ ID NO: 2292 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGQGQKHRLTCPSCDSYEKKPPKEFLERFKSLLQKMIHQHLSSRTHGSEDS

SEQ ID NO: 2293 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGRRQKDRLTCPSCDSYEKKPPKEFLERFKSLLQKMIHQHLSSRTHGSEDS

SEQ ID NO: 2294 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSTNPGQRQKHRLTCPSCDSYEKKPPKEFLERFKSLLQKMIHQHLSSRTHGSEDS

SEQ ID NO: 2295 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2296 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSDNPGRRQKHRLTCPSCDSYEKKPPKEFLERFKSLLQKMIHQHLSSRTHGSEDS

SEQ ID NO: 2297 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGRGQKHRLTCPSCDSYEKKPPKEFLERFKSLLQKMIHQHLSSRTHGSEDS

SEQ ID NO: 2298 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGRRQKHTLECPSCDSYEKKPPKEFLERFKSLLQKMIHQHLSSRTHGSEDS

SEQ ID NO: 2299 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSTNPGRGQKHRLTCPSCDSYEKKPPKEFLERFKSLLQKMIHQHLSSRTHGSEDS

SEQ ID NO: 2300 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSTNPGRDQKHRLTCPSCDSYEKKPPKEFLERFKSLLQKMIHQHLSSRTHGSEDS

SEQ ID NO: 2301 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2302 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGRRQKHTLTCPSCDSYEKKPPKEFLERFKSLLQKMIHQHLSSRTHGSEDS

SEQ ID NO: 2303 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINESIKKLKRKPPSTNAGRRQKHRLTCPSCDSYEKKPPKEFLERFKSLLQKMIHQHLSSRTHGSEDS

SEQ ID NO: 2304 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRGQKHRLECPSCDSYEKKPPKEFLERFKSLLQKMIHQHLSSRTHGSEDS

SEQ ID NO: 2305 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRRQKHTLECPSCDSYEKKPPKEFLERFKSLLQKMIHQHLSSRTHGSEDS

SEQ ID NO: 2306 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKPPSDNAGRRQKHRLTCPSCDSYEKKPPKEFLERFKSLLQKMIHQHLSSRTHGSEDS

SEQ ID NO: 2307 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGGRQKHTLTCPSCDSYEKKPPKEFLERFKSLLQKMIHQHLSSRTHGSEDS

SEQ ID NO: 2308 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSTNAGQRQKHRLTCPSCDSYEKKPPKEFLERFKSLLQKMIHQHLSSRTHGSEDS

SEQ ID NO: 2309 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 2310 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSDNAGQRQKHRLTCPSCDSYEKKPPKEFLERFKSLLQKMIHQHLSSRTHGSEDS

SEQ ID NO: 2311 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRRQKDRLECPSCDSYEKKPPKEFLERFKSLLQKMIHQHLSSRTHGSEDS

SEQ ID NO: 2312 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2313 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSTNPGRGQKHRLTCPSCDSYEKKPPKEFLERFKSLLQKMIHQHLSSRTHGSEDS

SEQ ID NO: 2314 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSDNPGRRQKHRLTCPSCDSYEKKPPKEFLERFKSLLQKMIHQHLSSRTHGSEDS

SEQ ID NO: 2315 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSTNPGGRQKHRLTCPSCDSYEKKPPKEFLERFKSLLQKMIHQHLSSRTHGSEDS

SEQ ID NO: 2316 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 2317 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGQRQKHTLTCPSCDSYEKKPPKEFLERFKSLLQKMIHQHLSSRTHGSEDS

SEQ ID NO: 2318 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSTNAGRRQKHRLTCPSCDSYEKKPPKEFLERFKSLLQKMIHQHLSSRTHGSEDS

SEQ ID NO: 2319 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKDTLTCPSCDSYEKKPPKEFLERFKSLLQKMIHQHLSSRTHGSEDS

SEQ ID NO: 2320 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKVPSTNAGRRQKHRLTCPSCDSYEKKPPKEFLERFKSLLQKMIHQHLSSRTHGSEDS

SEQ ID NO: 2321 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSDNAGRRQKHRLTCPSCDSYEKKPPKEFLERFKSLLQKMIHQHLSSRTHGSEDS

SEQ ID NO: 2322 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKVPSDNAGRRQKHRLTCPSCDSYEKKPPKEFLERFKSLLQKMIHQHLSSRTHGSEDS

SEQ ID NO: 2323 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSTNAGQRQKHRLTCPSCDSYEKKPPKEFLERFKSLLQKMIHQHLSSRTHGSEDS

SEQ ID NO: 2324 - protein, 162 aa, synthetic construct
MRSSPGNMERIVICLMVIFLGTLVHKSSSQGQDRIMIRMRQLIDTVDQLKNYVNDLVPEFLPAPEDVETGCEWSAFSCFQKAQLKSANTGNNERIINVSIKKLKRKVPSTNAGRRQKHRLTCPSCDSYEKKPPKEFLERFKSLLQKMIHQHLSSRTHGSEDS

SEQ ID NO: 2325 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRRQKHTLTCPSCDSYEKKPPKEFLERFKSLLQKMIHQHLSSRTHGSEDS

SEQ ID NO: 2326 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGQRQKHRLTCPSCDSYEKKPPKEFLERFKSLLQKMIHQHLSSRTHGSEDS

SEQ ID NO: 2327 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGQRQKHRLTCPSCDSYEKKPPKEFLERFKSLLQKMIHQHLSSRTHGSEDS

SEQ ID NO: 2328 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRGQKHRLECPSCDSYEKKPPKEFLERFKSLLQKMIHQHLSSRTHGSEDS

SEQ ID NO: 2329 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSTNPGRRQKHRLTCPSCDSYEKKPPKEFLERFKSLLQKMIHQHLSSRTHGSEDS

SEQ ID NO: 2330 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNPGRRQKHRLTCPSCDSYEKKPPKEFLERFKSLLQKMIHQHLSSRTHGSEDS

SEQ ID NO: 2331 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGGRQKHRLECPSCDSYEKKPPKEFLERFKSLLQKMIHQHLSSRTHGSEDS

SEQ ID NO: 2332 - protein, 162 aa, synthetic construct
MRSSPGNMERIVICLMVIFLGTLVHKSSSQGQDRFMIRMRQLIDTVDQLKNYVNDLVPEFLPAPEDVETGCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 2333 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRRQKDRLTCPSCDSYEKKPPKEFLERFKSLLQKMIHQHLSSRTHGSEDS

SEQ ID NO: 2334 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSTNAGGRQKHRLTCPSCDSYEKKPPKEFLERFKSLLQKMIHQHLSSRTHGSEDS

SEQ ID NO: 2335 - protein, 162 aa, synthetic construct
MRSSPGNMERIVICLMVIFLGTLVHKSSSQGQDRFMIRMRQLIDTVDQLKNYVNDLVPEFLPAPEDVETGCEWSAFSCFQKAQLKSANTGNNERIINVSIKKLKRKPPSTNPGRRQKHRLTCPSCDSYEKKPPKEFLERFKSLLQKMIHQHLSSRTHGSEDS

SEQ ID NO: 2336 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKVPSTNPGRRQKHRLTCPSCDSYEKKPPKEFLERFKSLLQKMIHQHLSSRTHGSEDS

SEQ ID NO: 2337 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNAGRRQKHRLTCPSCDSYEKKPPKEFLERFKSLLQKMIHQHLSSRTHGSEDS

SEQ ID NO: 2338 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSTNAGRGQKHRLTCPSCDSYEKKPPKEFLERFKSLLQKMIHQHLSSRTHGSEDS

SEQ ID NO: 2339 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2340 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRRQKHTLTCPSCDSYEKKPPKEFLERFKSLLQKMIHQHLSSRTHGSEDS

SEQ ID NO: 2341 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRRQKHTLTCPSCDSYEKKPPKEFLERFKSLLQKMIHQHLSSRTHGSEDS

SEQ ID NO: 2342 - protein, 162 aa, synthetic construct
MRSSPGNMERIVICLMVIFLGTLVHKSSSQGQDRFMIRMRQLIDTVDQLKNYVNDLVPEFLPAPEDVETGCEWSAFSCFQKAQLKSANTGNNERIINVSIKKLKRKVPSTNAGRRQKHRLTCPSCDSYEKKPPKEFLERFKSLLQKMIHQHLSSRTHGSEDS

SEQ ID NO: 2343 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSTNPGGRQKHRLTCPSCDSYEKKPPKEFLERFKSLLQKMIHQHLSSRTHGSEDS

SEQ ID NO: 2344 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGRRQKHTLTCPSCDSYEKKPPKEFLERFKSLLQKMIHQHLSSRTHGSEDS

SEQ ID NO: 2345 - protein, 162 aa, synthetic construct
MRSSPGNMERIVICLMVIFLGTLVHKSSSQGQDRIMIRMRQLIDTVDQLKNYVNDLVPEFLPAPEDVETGCEWSAFSCFQKAQLKSANTGNNERIINVSIKKLKRKPPSTNAGRGQKHRLTCPSCDSYEKKPPKEFLERFKSLLQKMIHQHLSSRTHGSEDS

SEQ ID NO: 2346 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRRQKHRLECPSCDSYEKKPPKEFLERFKSLLQKMIHQHLSSRTHGSEDS

SEQ ID NO: 2347 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKVPSTNAGRRQKHRLTCPSCDSYEKKPPKEFLERFKSLLQKMIHQHLSSRTHGSEDS

SEQ ID NO: 2348 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGQRQKHRLECPSCDSYEKKPPKEFLERFKSLLQKMIHQHLSSRTHGSEDS

SEQ ID NO: 2349 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGRQKHRLECPSCDSYEKKPPKEFLERFKSLLQKMIHQHLSSRTHGSEDS

SEQ ID NO: 2350 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNPGRRQKHRLECPSCDSYEKKPPKEFLERFKSLLQKMIHQHLSSRTHGSEDS

SEQ ID NO: 2351 - protein, 162 aa, synthetic construct
MRSSPGNMERIVICLMVIFLGTLVHKSSSQGQDRFMIRMRQLIDIVDQLKNYVNDLVPEFLPAPEDVETGCEWSAFSCFQKAQLKSANTGNNERIINVSIKKLKRKVPSTNPGRRQKHRLTCPSCDSYEKKPPKEFLERFKSLLQKMIHQHLSSRTHGSEDS

SEQ ID NO: 2352 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSTNAGGRQKHRLTCPSCDSYEKKPPKEFLERFKSLLQKMIHQHLSSRTHGSEDS

SEQ ID NO: 2353 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSTNAGRGQKHRLTCPSCDSYEKKPPKEFLERFKSLLQKMIHQHLSSRTHGSEDS

SEQ ID NO: 2354 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSTNAGQRQKHRLTCPSCDSYEKKPPKEFLERFKSLLQKMIHQHLSSRTHGSEDS

SEQ ID NO: 2355 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGRRQKHRLECPSCDSYEKKPPKEFLERFKSLLQKMIHQHLSSRTHGSEDS

SEQ ID NO: 2356 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKVPSTNAGRRQKHRLTCPSCDSYEKKPPKEFLERFKSLLQKMIHQHLSSRTHGSEDS

SEQ ID NO: 2357 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKVPSTNPGRRQKHRLECPSCDSYEKKPPKEFLERFKSLLQKMIHQHLSSRTHGSEDS

SEQ ID NO: 2358 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSDNAGRRQKHRLTCPSCDSYEKKPPKEFLERFKSLLQKMIHQHLSSRTHGSEDS

SEQ ID NO: 2359 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGRRQKHTLTCPSCDSYEKKPPKEFLERFKSLLQKMIHQHLSSRTHGSEDS

SEQ ID NO: 2360 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSDNAGRRQKHRLTCPSCDSYEKKPPKEFLERFKSLLQKMIHQHLSSRTHGSEDS

SEQ ID NO: 2361 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRRQKHTLECPSCDSYEKKPPKEFLERFKSLLQKMIHQHLSSRTHGSEDS

SEQ ID NO: 2362 - protein, 162 aa, synthetic construct
MRSSPGNMERIVICLMVIFLGTLVHKSSSQGQDRIMIRMRQLIDTVDQLKNYVNDLVPEFLPAPEDVETGCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 2363 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQKAQLKSANTGNNERIINVSIKKLKRKPPSTNPGRRQKHRLTCPSCDSYEKKPPKEFLERFKSLLQKMIHQHLSSRTHGSEDS

SEQ ID NO: 2364 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSTNPGQRQKHRLTCPSCDSYEKKPPKEFLERFKSLLQKMIHQHLSSRTHGSEDS

SEQ ID NO: 2365 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPSTNAGRRQKHRLECPSCDSYEKKPPKEFLERFKSLLQKMIHQHLSSRTHGSEDS

SEQ ID NO: 2366 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSTNPGRGQKHRLTCPSCDSYEKKPPKEFLERFKSLLQKMIHQHLSSRTHGSEDS

SEQ ID NO: 2367 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSTNPGRGQKHRLTCPSCDSYEKKPPKEFLERFKSLLQKMIHQHLSSRTHGSEDS

SEQ ID NO: 2368 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRGQKHRLTCPSCDSYEKKPPKEFLERFKSLLQKMIHQHLSSRTHGSEDS

SEQ ID NO: 2369 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHTLECPSCDSYEKKPPKEFLERFKSLLQKMIHQHLSSRTHGSEDS

SEQ ID NO: 2370 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGRRQKHRLECPSCDSYEKKPPKEFLERFKSLLQKMIHQHLSSRTHGSEDS

SEQ ID NO: 2371 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2372 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSDNAGRRQKHRLTCPSCDSYEKKPPKEFLERFKSLLQKMIHQHLSSRTHGSEDS

SEQ ID NO: 2373 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKVPSTNAGRRQKHRLTCPSCDSYEKKPPKEFLERFKSLLQKMIHQHLSSRTHGSEDS

SEQ ID NO: 2374 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSTNAGQRQKHRLTCPSCDSYEKKPPKEFLERFKSLLQKMIHQHLSSRTHGSEDS

SEQ ID NO: 2375 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGGRQKHTLTCPSCDSYEKKPPKEFLERFKSLLQKMIHQHLSSRTHGSEDS

SEQ ID NO: 2376 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSTNAGRGQKHRLTCPSCDSYEKKPPKEFLERFKSLLQKMIHQHLSSRTHGSEDS

SEQ ID NO: 2377 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSDNPGQRQKHRLTCPSCDSYEKKPPKEFLERFKSLLQKMIHQHLSSRTHGSEDS

SEQ ID NO: 2378 - protein, 162 aa, synthetic construct
MRSSPGNMERIVICLMVIFLGTLVHKSSSQGQDRIMIRMRQLIDTVDQLKNYVNDLVPEFLPAPEDVETGCEWSAFSCFQKAQLKSANTGNNERIINVSIKKLKRKPPSTNPGRRQKHRLTCPSCDSYEKKPPKEFLERFKSLLQKMIHQHLSSRTHGSEDS

SEQ ID NO: 2379 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNPGRRQKHRLTCPSCDSYEKKPPKEFLERFKSLLQKMIHQHLSSRTHGSEDS

SEQ ID NO: 2380 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSTNPGRRQKHRLTCPSCDSYEKKPPKEFLERFKSLLQKMIHQHLSSRTHGSEDS

SEQ ID NO: 2381 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKVPSTNPGRRQKHRLTCPSCDSYEKKPPKEFLERFKSLLQKMIHQHLSSRTHGSEDS

SEQ ID NO: 2382 - protein, 162 aa, synthetic construct
MRSSPGNMERIVICLMVIFLGTLVHKSSSQGQDRHMIRMRQLIDTVDQLKNYVNDLVPEFLPAPEDVETGCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 2383 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2384 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2385 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 2386 - protein, 162 aa, synthetic construct
MRSSPGNMERIVICLMVIFLGTLVHKSSSQGQDRFMIRMRQLIDTVDQLKNYVNDLVPEFLPAPEDVETNCEWSAFSCFQKAQLKSANTGNNERIINVSIKKLKRKVPSTNPGRRQKHRLTCPSCDSYEKKPPKEFLERFKSLLQKMIHQHLSSRTHGSEDS

SEQ ID NO: 2387 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSTNAGRRQKHRLTCPSCDSYEKKPPKEFLERFKSLLQKMIHQHLSSRTHGSEDS

SEQ ID NO: 2388 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGQRQKHRLTCPSCDSYEKKPPKEFLERFKSLLQKMIHQHLSSRTHGSEDS

SEQ ID NO: 2389 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGGRQKHRLTCPSCDSYEKKPPKEFLERFKSLLQKMIHQHLSSRTHGSEDS

SEQ ID NO: 2390 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKVPSTNPGRRQKHRLTCPSCDSYEKKPPKEFLERFKSLLQKMIHQHLSSRTHGSEDS

SEQ ID NO: 2391 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKPPSTNPGRRQKHRLTCPSCDSYEKKPPKEFLERFKSLLQKMIHQHLSSRTHGSEDS

SEQ ID NO: 2392 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSDNAGRRQKHRLECPSCDSYEKKPPKEFLERFKSLLQKMIHQHLSSRTHGSEDS

SEQ ID NO: 2393 - protein, 162 aa, synthetic construct
MRSSPGNMERIVICLMVIFLGTLVHKSSSQGQDRIMIRMRQLIDIVDQLKNYVNDLVPEFLPAPEDVETNCEWSAFSCFQKAQLKSANTGNNERIINVSIKKLKRKVPSTNPGRRQKHRLTCPSCDSYEKKPPKEFLERFKSLLQKMIHQHLSSRTHGSEDS

SEQ ID NO: 2394 - protein, 162 aa, synthetic construct
MRSSPGNMERIVICLMVIFLGTLVHKSSSQGQDRIMIRMRQLIDTVDQLKNYVNDLVPEFLPAPEDVETNCEWSAFSCFQKAQLKSANTGNNERIINVSIKKLKRKPPSTNPGRRQKHRLTCPSCDSYEKKPPKEFLERFKSLLQKMIHQHLSSRTHGSEDS

SEQ ID NO: 2395 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNPGRRQKHTLTCPSCDSYEKKPPKEFLERFKSLLQKMIHQHLSSRTHGSEDS

SEQ ID NO: 2396 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQKAQLKSANTGNNERIINVSIKKLKRKPPSTNAGGRQKHRLTCPSCDSYEKKPPKEFLERFKSLLQKMIHQHLSSRTHGSEDS

SEQ ID NO: 2397 - protein, 162 aa, synthetic construct
MRSSPGNMERIVICLMVIFLGTLVHKSSSQGQDRFMIRMRQLIYIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2398 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERITNESIKKLKRKPPSDNAGRRQKHRLTCPSCDSYEKKPPKEFLERFKSLLQKMIHQHLSSRTHGSEDS

SEQ ID NO: 2399 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERKINESIKKLKRKPPSDNAGRRQKHRLTCPSCDSYEKKPPKEFLERFKSLLQKMIHQHLSSRTHGSEDS

SEQ ID NO: 2400 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFRDAQLKSANTGNNERIINESIKKLKRKPPSDNAGRRQKHRLTCPSCDSYEKKPPKEFLERFKSLLQKMIHQHLSSRTHGSEDS

SEQ ID NO: 2401 - protein, 162 aa, synthetic construct
MRSSPGNMERIVICLMVIFLGTLVHKSSSQGQDRFMIRMRQLIWIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2402 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQTKSANTGNNERIINESIKKLKRKPPSDNAGRRQKHRLTCPSCDSYEKKPPKEFLERFKSLLQKMIHQHLSSRTHGSEDS

SEQ ID NO: 2403 - protein, 162 aa, synthetic construct
MRSSPGNMERIVICLMVIFLGTLVHKSSSQGQDRFMIRMRQLIDNVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2404 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKRKPPSHNAGRRQKHRLTCPSCDSYEKKPPKEFLERFKSLLQKMIHQHLSSRTHGSEDS

SEQ ID NO: 2405 - protein, 162 aa, synthetic construct
MRSSPGNMERIVICLMVIFLGTLVHKSSSQGQDRFMIRMRQLIDAVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2406 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCAQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2407 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIIKVSIKKLKRKPPSTNAGQDQKHRLTCPSCDSYEKKPPKEFLERFKSLLQKMIHQHLSSRTHGSEDS

SEQ ID NO: 2408 - protein, 162 aa, synthetic construct
MRSSPGNMERIVICLMVIFLGTLVHKSSSQGQDRFMIRMRQLIDIVDRLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2409 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKRKPKSDNAGRRQKHRLTCPSCDSYEKKPPKEFLERFKSLLQKMIHQHLSSRTHGSEDS

SEQ ID NO: 2410 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKRKPPSRNAGRRQKHRLTCPSCDSYEKKPPKEFLERFKSLLQKMIHQHLSSRTHGSEDS

SEQ ID NO: 2411 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIIPESIKKLKRKPPSDNAGRRQKHRLTCPSCDSYEKKPPKEFLERFKSLLQKMIHQHLSSRTHGSEDS

SEQ ID NO: 2412 - protein, 162 aa, synthetic construct
MRSSPGNMERIVICLMVIFLGTLVHKSSSQGQDRFMIRMRQLIDYVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2413 - protein, 162 aa, synthetic construct
MRSSPGNMERIVICLMVIFLGTLVHKSSSQGQDRHMTRMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2414 - protein, 162 aa, synthetic construct
MRSSPGNMERIVICLMVIFLGTLVHKSSSQGQDRHMIRMRQLIDIVDQLKNKVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2415 - protein, 162 aa, synthetic construct
MRSSPGNMERIVICLMVIFLGTLVHKSSSQGQDRFMIRMRQLIDIVDQLKNYVNDLVPEFLPAPEDVETNCEWSATSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2416 - protein, 162 aa, synthetic construct
MRSSPGNMERIVICLMVIFLGTLVHKSSSQGQDRFMIRMRQLIGIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2417 - protein, 162 aa, synthetic construct
MRSSPGNMERIVICLMVIFLGTLVHKSSSQGQDRHMSRMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2418 - protein, 162 aa, synthetic construct
MRSSPGNMERIVICLMVIFLGTLVHKSSSQGQDRFMIRMRQLIDIVDQLKNYVNDLVPEFLPAPEDKETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2419 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRDPPSTNAGQDQKHRLTCPSCDSYEKKPPKEFLERFKSLLQKMIHQHLSSRTHGSEDS

SEQ ID NO: 2420 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFDDAQLKSANTGNNERIINESIKKLKRKPPSDNAGRRQKHRLTCPSCDSYEKKPPKEFLERFKSLLQKMIHQHLSSRTHGSEDS

SEQ ID NO: 2421 - protein, 162 aa, synthetic construct
MRSSPGNMERIVICLMVIFLGTLVHKSSSQGQDRHMIRMRQLIDIVDQLKNYVNDLVPEFLPAPEDVETGCEWSVFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2422 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQHAQLKSANTGNNERIINVSIKKLKRKPPSTNAGQDQKHRLTCPSCDSYEKKPPKEFLERFKSLLQKMIHQHLSSRTHGSEDS

SEQ ID NO: 2423 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNPRIINVSIKKLKRKPPSTNAGQDQKHRLTCPSCDSYEKKPPKEFLERFKSLLQKMIHQHLSSRTHGSEDS

SEQ ID NO: 2424 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINERIKKLKRKPPSDNAGRRQKHRLTCPSCDSYEKKPPKEFLERFKSLLQKMIHQHLSSRTHGSEDS

SEQ ID NO: 2425 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDMQLKSANTGNNERIINVSIKKLKRKPPSTNAGQDQKHRLTCPSCDSYEKKPPKEFLERFKSLLQKMIHQHLSSRTHGSEDS

SEQ ID NO: 2426 - protein, 162 aa, synthetic construct
MRSSPGNMERIVICLMVIFLGTLVHKSSSQGQDEFMIRMRQLIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2427 - protein, 162 aa, synthetic construct
MRSSPGNMERIVICLMVIFLGTLVHKSSSQGQDRHMIRMRQLIDIVDQLKNGVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2428 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQRAQLKSANTGNNERIINESIKKLKRKPPSDNAGRRQKHRLTCPSCDSYEKKPPKEFLERFKSLLQKMIHQHLSSRTHGSEDS

SEQ ID NO: 2429 - protein, 162 aa, synthetic construct
MRSSPGNMERIVICLMVIFLGTLVHKSSSQGQDRHMIRMRQLIAIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2430 - protein, 162 aa, synthetic construct
MRSSPGNMERIVICLMVIFLGTLVHKSSSQGQDRFMIRMRQLIDIVRQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2431 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINFSIKKLKRKPPSDNAGRRQKHRLTCPSCDSYEKKPPKEFLERFKSLLQKMIHQHLSSRTHGSEDS

SEQ ID NO: 2432 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQWAQLKSANTGNNERIINVSIKKLKRKPPSTNAGQDQKHRLTCPSCDSYEKKPPKEFLERFKSLLQKMIHQHLSSRTHGSEDS

SEQ ID NO: 2433 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTYNNERIINVSIKKLKRKPPSTNAGQDQKHRLTCPSCDSYEKKPPKEFLERFKSLLQKMIHQHLSSRTHGSEDS

SEQ ID NO: 2434 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQHAQLKSANTGNNERIINESIKKLKRKPPSDNAGRRQKHRLTCPSCDSYEKKPPKEFLERFKSLLQKMIHQHLSSRTHGSEDS

SEQ ID NO: 2435 - protein, 162 aa, synthetic construct
MRSSPGNMERIVICLMVIFLGTLVHKSSSQGQDRHMNRMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2436 - protein, 162 aa, synthetic construct
MRSSPGNMERIVICLMVIFLGTLVHKSSSQGQDRFMIWMRQLIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2437 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQYAQLKSANTGNNERIINVSIKKLKRKPPSTNAGQDQKHRLTCPSCDSYEKKPPKEFLERFKSLLQKMIHQHLSSRTHGSEDS

SEQ ID NO: 2438 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDKQLKSANTGNNERIINESIKKLKRKPPSDNAGRRQKHRLTCPSCDSYEKKPPKEFLERFKSLLQKMIHQHLSSRTHGSEDS

SEQ ID NO: 2439 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQRAQLKSANTGNNERIINVSIKKLKRKPPSTNAGQDQKHRLTCPSCDSYEKKPPKEFLERFKSLLQKMIHQHLSSRTHGSEDS

SEQ ID NO: 2440 - protein, 162 aa, synthetic construct
MRSSPGNMERIVICLMVIFLGTLVHKSSSQGQDRHMIRMRQLIDIVDQLKNYVNDEVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2441 - protein, 162 aa, synthetic construct
MRSSPGNMERIVICLMVIFLGTLVHKSSSQGQDRHMIRMRQLIDSVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2442 - protein, 162 aa, synthetic construct
MRSSPGNMERIVICLMVIFLGTLVHKSSSQGQDRFMIRMRQLIDIVDQLKNYVNDSVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2443 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSAKKLKRKPPSTNAGQDQKHRLTCPSCDSYEKKPPKEFLERFKSLLQKMIHQHLSSRTHGSEDS

SEQ ID NO: 2444 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKILKRKPPSTNAGQDQKHRLTCPSCDSYEKKPPKEFLERFKSLLQKMIHQHLSSRTHGSEDS

SEQ ID NO: 2445 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDWQLKSANTGNNERIINESIKKLKRKPPSDNAGRRQKHRLTCPSCDSYEKKPPKEFLERFKSLLQKMIHQHLSSRTHGSEDS

SEQ ID NO: 2446 - protein, 162 aa, synthetic construct
MRSSPGNMERIVICLMVIFLGTLVHKSSSQGQDRFMIRMRQLIDIVDQLKNYVNDLVMEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2447 - protein, 162 aa, synthetic construct
MRSSPGNMERIVICLMVIFLGTLVHKSSSQGQDRFMWRMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2448 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKRKPPSTNRGRRQKHRLTCPSCDSYEKKPPKEFLERFKSLLQKMIHQHLSSRTHGSEDS

SEQ ID NO: 2449 - protein, 162 aa, synthetic construct
MRSSPGNMERIVICLMVIFLGTLVHKSSSQGQDRHMIRMRQLIDIVKQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2450 - protein, 162 aa, synthetic construct
MRSSPGNMERIVICLMVIFLGTLVHKSSSQGQDRFMIRMRQLIDIVDQLKNYVNDLVKEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2451 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINASIKKLKRKVPSTNAGRRQKHRLTCPSCDSYEKKPPKEFLERFKSLLQKMIHQHLSSRTHGSEDS

SEQ ID NO: 2452 - protein, 162 aa, synthetic construct
MRSSPGNMERIVICLMVIFLGTLVHKSSSQGQDRHMIRMRQLITIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2453 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINKSIKKLKRKPPSTNAGQDQKHRLTCPSCDSYEKKPPKEFLERFKSLLQKMIHQHLSSRTHGSEDS

SEQ ID NO: 2454 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKRKPPKTNAGRRQKHRLTCPSCDSYEKKPPKEFLERFKSLLQKMIHQHLSSRTHGSEDS

SEQ ID NO: 2455 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERITNVSIKKLKRKPPSTNAGQDQKHRLTCPSCDSYEKKPPKEFLERFKSLLQKMIHQHLSSRTHGSEDS

SEQ ID NO: 2456 - protein, 162 aa, synthetic construct
MRSSPGNMERIVICLMVIFLGTLVHKSSSQGQDRHMWRMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2457 - protein, 162 aa, synthetic construct
MRSSPGNMERIVICLMVIFLGTLVHKSSSQGIDRFMIRMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2458 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDALLKSANTGNNERIINESIKKLKRKVPSTNAGRRQKHRLTCPSCDSYEKKPPKEFLERFKSLLQKMIHQHLSSRTHGSEDS

SEQ ID NO: 2459 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIANESIKKLKRKVPSTNAGRRQKHRLTCPSCDSYEKKPPKEFLERFKSLLQKMIHQHLSSRTHGSEDS

SEQ ID NO: 2460 - protein, 162 aa, synthetic construct
MRSSPGNMERIVICLMVIFLGTLVHKSSSQGQDRHMIRMRQLIDIVFQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2461 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKRPSTNAGQDQKHRLTCPSCDSYEKKPPKEFLERFKSLLQKMIHQHLSSRTHGSEDS

SEQ ID NO: 2462 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIIRESIKKLKRKVPSTNAGRRQKHRLTCPSCDSYEKKPPKEFLERFKSLLQKMIHQHLSSRTHGSEDS

SEQ ID NO: 2463 - protein, 162 aa, synthetic construct
MRSSPGNMERIVICLMVIFLGTLVHKSSSQGQDRHMIRMRQLIDIVDQLKNYVNDLVPEFLPAPEDGETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2464 - protein, 162 aa, synthetic construct
MRSSPGNMERIVICLMVIFLGTLVHKSSSQGQDRFMIWMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2465 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKVLKRKVPSTNAGRRQKHRLTCPSCDSYEKKPPKEFLERFKSLLQKMIHQHLSSRTHGSEDS

SEQ ID NO: 2466 - protein, 162 aa, synthetic construct
MRSSPGNMERIVICLMVIFLGTLVHKSSSQGQDRHMIRMRQLIVIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2467 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKVPSTRAGRRQKHRLTCPSCDSYEKKPPKEFLERFKSLLQKMIHQHLSSRTHGSEDS

SEQ ID NO: 2468 - protein, 162 aa, synthetic construct
MRSSPGNMERIVICLMVIFLGTLVHKSSSQGQDRHMIRMRQLIDIVDQLKNYVNDLVPEFKPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2469 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFGDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2470 - protein, 162 aa, synthetic construct
MRSSPGNMERIVICLMVIFLGTLVHKSSSQGQDRFMHRMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2471 - protein, 162 aa, synthetic construct
MRSSPGNMERIVICLMVIFLGTLVHKSSSQGQDRFMERMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2472 - protein, 162 aa, synthetic construct
MRSSPGNMERIVICLMVIFLGTLVHKSSSQGQDRFMIRMRQLIDGVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2473 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINASIKKLKRKPPSTNAGRRQKHRLTCPSCDSYEKKPPKEFLERFKSLLQKMIHQHLSSRTHGSEDS

SEQ ID NO: 2474 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCLQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2475 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINGSIKKLKRKVPSTNAGRRQKHRLTCPSCDSYEKKPPKEFLERFKSLLQKMIHQHLSSRTHGSEDS

SEQ ID NO: 2476 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINYSIKKLKRKPPSTNAGRRQKHRLTCPSCDSYEKKPPKEFLERFKSLLQKMIHQHLSSRTHGSEDS

SEQ ID NO: 2477 - protein, 162 aa, synthetic construct
MRSSPGNMERIVICLMVIFLGTLVHKSSSQGQDRFMIRMRQLIIIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2478 - protein, 162 aa, synthetic construct
MRSSPGNMERIVICLMVIFLGTLVHKSSSQGQDRHMIRMRQLIIIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2479 - protein, 162 aa, synthetic construct; identical to SEQ ID NO: 1558

SEQ ID NO: 2480 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFDDAQLKSANTGNNERIINESIKKLKRKPPSTNAGRRQKHRLTCPSCDSYEKKPPKEFLERFKSLLQKMIHQHLSSRTHGSEDS

SEQ ID NO: 2481 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNKRIINVSIKKLKRKPPSTNAGQDQKHRLTCPSCDSYEKKPPKEFLERFKSLLQKMIHQHLSSRTHGSEDS

SEQ ID NO: 2482 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFYDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2483 - protein, 162 aa, synthetic construct
MRSSPGNMERIVICLMVIFLGTLVHKSSSQGQDRHMIRMRQLIKIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2484 - protein, 162 aa, synthetic construct
MRSSPGNMERIVICLMVIFLGTLVHKSSSQGQDRHMWRMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2485 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINEPIKKLKRKPPSDNAGRRQKHRLTCPSCDSYEKKPPKEFLERFKSLLQKMIHQHLSSRTHGSEDS

SEQ ID NO: 2486 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKTLKRKPPSTNAGRRQKHRLTCPSCDSYEKKPPKEFLERFKSLLQKMIHQHLSSRTHGSEDS

SEQ ID NO: 2487 - protein, 162 aa, synthetic construct
MRSSPGNMERIVICLMVIFLGTLVHKSSSQGQDRFMIRMRQLIDIVDQLKNYVNDLVPEFLPAPEDVETNCEWSASSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2488 - protein, 162 aa, synthetic construct
MRSSPGNMERIVICLMVIFLGTLVHKSSSQGQDRHMIRMRQLIDAVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2489 - protein, 162 aa, synthetic construct
MRSSPGNMERIVICLMVIFLGTLVHKSSSQGQDRFMIRMRQLIDIVDQLKNYVNDDVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2490 - protein, 162 aa, synthetic construct
MRSSPGNMERIVICLMVIFLGTLVHKSSSQGQDRFMINMRQLIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2491 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNSRIINESIKKLKRKPPSTNAGRRQKHRLTCPSCDSYEKKPPKEFLERFKSLLQKMIHQHLSSRTHGSEDS

SEQ ID NO: 2492 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINNSIKKLKRKVPSTNAGRRQKHRLTCPSCDSYEKKPPKEFLERFKSLLQKMIHQHLSSRTHGSEDS

SEQ ID NO: 2493 - protein, 162 aa, synthetic construct
MRSSPGNMERIVICLMVIFLGTLVHKSSSQGQDRHMDRMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2494 - protein, 162 aa, synthetic construct
MRSSPGNMERIVICLMVIFLGTLVHKSSSQGQDRFMIRMRQLIPIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2495 - protein, 162 aa, synthetic construct
MRSSPGNMERIVICLMVIFLGTLVHKSSSQGQDRFMIRMRQLIFIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2496 - protein, 162 aa, synthetic construct
MRSSPGNMERIVICLMVIFLGTLVHKSSSQGQDRHMIRMRQLIDTVDQLKNYVNDLVPEFLPAPEDVRTNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2497 - protein, 162 aa, synthetic construct
MRSSPGNMERIVICLMVIFLGTLVHKSSSQGQDRFMNRMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2498 - protein, 162 aa, synthetic construct
MRSSPGNMERIVICLMVIFLGTLVHKSSSQGQDIHMIRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2499 - protein, 162 aa, synthetic construct
MRSSPGNMERIVICLMVIFLGTLVHKSSSQGQDRHMIRMRQLISIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2500 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKILKRKPPSTNAGRRQKHRLTCPSCDSYEKKPPKEFLERFKSLLQKMIHQHLSSRTHGSEDS

SEQ ID NO: 2501 - protein, 162 aa, synthetic construct
MRSSPGNMERIVICLMVIFLGTLVHKSSSQGQDRHMIRMRQLIHIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2502 - protein, 162 aa, synthetic construct
MRSSPGNMERIVICLMVIFLGTLVHKSSSQGQDRHRIRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2503 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKVLKRKPPSTNAGQDQKHRLTCPSCDSYEKKPPKEFLERFKSLLQKMIHQHLSSRTHGSEDS

SEQ ID NO: 2504 - protein, 162 aa, synthetic construct
MRSSPGNMERIVICLMVIFLGTLVHKSSSQGQDRHMHRMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2505 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKVPSTKAGRRQKHRLTCPSCDSYEKKPPKEFLERFKSLLQKMIHQHLSSRTHGSEDS

SEQ ID NO: 2506 - protein, 162 aa, synthetic construct
MRSSPGNMERIVICLMVIFLGTLVHKSSSQGQDRHMIRMRQLIDAVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2507 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNRRIINESIKKLKRKPPSTNAGRRQKHRLTCPSCDSYEKKPPKEFLERFKSLLQKMIHQHLSSRTHGSEDS

SEQ ID NO: 2508 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKRKPWSTNAGRRQKHRLTCPSCDSYEKKPPKEFLERFKSLLQKMIHQHLSSRTHGSEDS

SEQ ID NO: 2509 - protein, 162 aa, synthetic construct
MRSSPGNMERIVICLMVIFLGTLVHKSSSQGQDRFMIRMRQLIDQVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2510 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKRKPQSTNAGRRQKHRLTCPSCDSYEKKPPKEFLERFKSLLQKMIHQHLSSRTHGSEDS

SEQ ID NO: 2511 - protein, 162 aa, synthetic construct
MRSSPGNMERIVICLMVIFLGTLVHKSSSQGQPRHMIRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2512 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINSSIKKLKRKVPSTNAGRRQKHRLTCPSCDSYEKKPPKEFLERFKSLLQKMIHQHLSSRTHGSEDS

SEQ ID NO: 2513 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERRINVSIKKLKRKPPSTNAGQDQKHRLTCPSCDSYEKKPPKEFLERFKSLLQKMIHQHLSSRTHGSEDS

SEQ ID NO: 2514 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFGDAQLKSANTGNNERIINESIKKLKRKVPSTNAGRRQKHRLTCPSCDSYEKKPPKEFLERFKSLLQKMIHQHLSSRTHGSEDS

SEQ ID NO: 2515 - protein, 162 aa, synthetic construct
MRSSPGNMERIVICLMVIFLGTLVHKSSSQGQDRHMIRMRQLIDIVDKLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2516 - protein, 162 aa, synthetic construct
MRSSPGNMERIVICLMVIFLGTLVHKSSSQGQDRHMHRMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2517 - protein, 162 aa, synthetic construct
MRSSPGNMERIVICLMVIFLGTLVHKSSSQGQDDFMIRMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2518 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKAKRKPPSTNAGRRQKHRLTCPSCDSYEKKPPKEFLERFKSLLQKMIHQHLSSRTHGSEDS

SEQ ID NO: 2519 - protein, 162 aa, synthetic construct
MRSSPGNMERIVICLMVIFLGTLVHKSSSQGQHRHMIRMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2520 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFKDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2521 - protein, 162 aa, synthetic construct
MRSSPGNMERIVICLMVIFLGTLVHKSSSQGQDRHMERMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2522 - protein, 162 aa, synthetic construct
MRSSPGNMERIVICLMVIFLGTLVHKSSSQGQDWHMIRMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2523 - protein, 162 aa, synthetic construct
MRSSPGNMERIVICLMVIFLGTLVHKSSSQGQDRHMIRMRQLIDTVDQLKNYVNDLVPEFLPAPEDVETNCEWSALSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2524 - protein, 162 aa, synthetic construct
MRSSPGNMERIVICLMVIFLGTLVHKSSSQGQDRFMIAMRQLIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2525 - protein, 162 aa, synthetic construct
MRSSPGNMERIVICLMVIFLGTLVHKSSSQGQDRHMIRMRQLIDQVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2526 - protein, 162 aa, synthetic construct
MRSSPGNMERIVICLMVIFLGTLVHKSSSQGQDTHMIRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2527 - protein, 162 aa, synthetic construct
MRSSPGNMERIVICLMVIFLGTLVHKSSSQGQDRFMIRMRQLIDFVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2528 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVPIKKLKRKPPSTNAGQDQKHRLTCPSCDSYEKKPPKEFLERFKSLLQKMIHQHLSSRTHGSEDS

SEQ ID NO: 2529 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIEKLKRKPPSTNAGRRQKHRLTCPSCDSYEKKPPKEFLERFKSLLQKMIHQHLSSRTHGSEDS

SEQ ID NO: 2530 - protein, 162 aa, synthetic construct
MRSSPGNMERIVICLMVIFLGTLVHKSSSQGQDRHMIRGRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2531 - protein, 162 aa, synthetic construct
MRSSPGNMERIVICLMVIFLGTLVHKSSSQGQDPHMIRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2532 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFFDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2533 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDLQLKSANTGNNERIINESIKKLKRKVPSTNAGRRQKHRLTCPSCDSYEKKPPKEFLERFKSLLQKMIHQHLSSRTHGSEDS

SEQ ID NO: 2534 - protein, 162 aa, synthetic construct
MRSSPGNMERIVICLMVIFLGTLVHKSSSQGQDRHMIRMRQLIDIVDQLKNYTNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 2535 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDIQLKSANTGNNERIINESIKKLKRKVPSTNAGRRQKHRLTCPSCDSYEKKPPKEFLERFKSLLQKMIHQHLSSRTHGSEDS

SEQ ID NO: 2536 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNRRIINESIKKLKRKVPSTNAGRRQKHRLTCPSCDSYEKKPPKEFLERFKSLLQKMIHQHLSSRTHGSEDS

SEQ ID NO: 2537 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKRKPSSTNAGRRQKHRLTCPSCDSYEKKPPKEFLERFKSLLQKMIHQHLSSRTHGSEDS

SEQ ID NO: 2538 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINMSIKKLKRKVPSTNAGRRQKHRLTCPSCDSYEKKPPKEFLERFKSLLQKMIHQHLSSRTHGSEDS

SEQ ID NO: 2539 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIFNESIKKLKRKPPSTNAGRRQKHRLTCPSCDSYEKKPPKEFLERFKSLLQKMIHQHLSSRTHGSEDS

SEQ ID NO: 2540 - protein, 162 aa, synthetic construct
MRSSPGNMERIVICLMVIFLGTLVHKSSSQGQDRHMIRMRQLIYIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2541 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKHPSTNAGRRQKHRLTCPSCDSYEKKPPKEFLERFKSLLQKMIHQHLSSRTHGSEDS

SEQ ID NO: 2542 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESSKKLKRKPPSTNAGRRQKHRLTCPSCDSYEKKPPKEFLERFKSLLQKMIHQHLSSRTHGSEDS

SEQ ID NO: 2543 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKPLKRKPPSDNAGRRQKHRLTCPSCDSYEKKPPKEFLERFKSLLQKMIHQHLSSRTHGSEDS

SEQ ID NO: 2544 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDHQLKSANTGNNERIINVSIKKLKRKPPSTNAGQDQKHRLTCPSCDSYEKKPPKEFLERFKSLLQKMIHQHLSSRTHGSEDS

SEQ ID NO: 2545 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCVQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2546 - protein, 162 aa, synthetic construct
MRSSPGNMERIVICLMVIFLGTLVHKSSSQGQDRFMIGMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2547 - protein, 162 aa, synthetic construct
MRSSPGNMERIVICLMVIFLGTLVHKSSSQGQDRHMIRMRQLIMIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2548 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAVSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2549 - protein, 162 aa, synthetic construct
MRSSPGNMERIVICLMVIFLGTLVHKSSSQGQDRHMIRMRQLILIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2550 - protein, 162 aa, synthetic construct
MRSSPGNMERIVICLMVIFLGTLVHKSSSQGQDRHMWRMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 2551 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINERIKKLKRKPPSTNAGRRQKHRLTCPSCDSYEKKPPKEFLERFKSLLQKMIHQHLSSRTHGSEDS

SEQ ID NO: 2552 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIYNESIKKLKRKPPSTNAGRRQKHRLTCPSCDSYEKKPPKEFLERFKSLLQKMIHQHLSSRTHGSEDS

SEQ ID NO: 2553 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKRKPGSTNAGRRQKHRLTCPSCDSYEKKPPKEFLERFKSLLQKMIHQHLSSRTHGSEDS

SEQ ID NO: 2554 - protein, 162 aa, synthetic construct
MRSSPGNMERIVICLMVIFLGTLVHKSSSQGQDRHMDRMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 2555 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKRKPASTNAGRRQKHRLTCPSCDSYEKKPPKEFLERFKSLLQKMIHQHLSSRTHGSEDS

SEQ ID NO: 2556 - protein, 162 aa, synthetic construct
MRSSPGNMERIVICLMVIFLGTLVHKSSSQGQDRFMKRMRQLIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2557 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAMSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2558 - protein, 162 aa, synthetic construct
MRSSPGNMERIVICLMVIFLGTLVHKSSSQGQDRHMNRMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2559 - protein, 162 aa, synthetic construct
MRSSPGNMERIVICLMVIFLGTLVHKSSSQGQDRHMIWMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2560 - protein, 162 aa, synthetic construct
MRSSPGNMERIVICLMVIFLGTLVHKSSSQGQDRFMRRMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2561 - protein, 162 aa, synthetic construct
MRSSPGNMERIVICLMVIFLGTLVHKSSSQGQDRHMTRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2562 - protein, 162 aa, synthetic construct
MRSSPGNMERIVICLMVIFLGTLVHKSSSQGQDRFMIMMRQLIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2563 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIIPVSIKKLKRKPPSTNAGQDQKHRLTCPSCDSYEKKPPKEFLERFKSLLQKMIHQHLSSRTHGSEDS

SEQ ID NO: 2564 - protein, 162 aa, synthetic construct
MRSSPGNMERIVICLMVIFLGTLVHKSSSQGQDRHMIRMRQLIDSVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 2565 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKGLKRKPPSTNAGRRQKHRLTCPSCDSYEKKPPKEFLERFKSLLQKMIHQHLSSRTHGSEDS

SEQ ID NO: 2566 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIDKLKRKPPSTNAGRRQKHRLTCPSCDSYEKKPPKEFLERFKSLLQKMIHQHLSSRTHGSEDS

SEQ ID NO: 2567 - protein, 162 aa, synthetic construct
MRSSPGNMERIVICLMVIFLGTLVHKSSSQGQDRHMIRMRELIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2568 - protein, 162 aa, synthetic construct
MRSSPGNMERIVICLMVIFLGTLVHKSSSQGQDRHMGRMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2569 - protein, 162 aa, synthetic construct
MRSSPGNMERIVICLMVIFLGTLVHKSSSQGQDRHMIRMRQLIDIVDQLKNYVNKLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2570 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAWLKSANTGNNERIINESIKKLKRKVPSTNAGRRQKHRLTCPSCDSYEKKPPKEFLERFKSLLQKMIHQHLSSRTHGSEDS

SEQ ID NO: 2571 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERKINESIKKLKRKPPSTNAGRRQKHRLTCPSCDSYEKKPPKEFLERFKSLLQKMIHQHLSSRTHGSEDS

SEQ ID NO: 2572 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVHSTNAGQDQKHRLTCPSCDSYEKKPPKEFLERFKSLLQKMIHQHLSSRTHGSEDS

SEQ ID NO: 2573 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKVPKTNAGQDQKHRLTCPSCDSYEKKPPKEFLERFKSLLQKMIHQHLSSRTHGSEDS

SEQ ID NO: 2574 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKSKRKPPSDNAGRRQKHRLTCPSCDSYEKKPPKEFLERFKSLLQKMIHQHLSSRTHGSEDS

SEQ ID NO: 2575 - protein, 162 aa, synthetic construct
MRSSPGNMERIVICLMVIFLGTLVHKSSSQGQDRFMIRMRQLRDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2576 - protein, 162 aa, synthetic construct
MRSSPGNMERIVICLMVIFLGTLVHKSSSQGQDRFMIRMRQLIWIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2577 - protein, 162 aa, synthetic construct
MRSSPGNMERIVICLMVIFLGTLVHKSSSQGQRRFMIRMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2578 - protein, 162 aa, synthetic construct
MRSSPGNMERIVICLMVIFLGTLVHKSSSQGQDRHMIRMRQLIDIVDQLKNYVNRLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2579 - protein, 162 aa, synthetic construct; identical to SEQ ID NO: 1715

SEQ ID NO: 2580 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINTSIKKLKRKVPSTNAGRRQKHRLTCPSCDSYEKKPPKEFLERFKSLLQKMIHQHLSSRTHGSEDS

SEQ ID NO: 2581 - protein, 162 aa, synthetic construct
MRSSPGNMERIVICLMVIFLGTLVHKSSSQGQDRFMIRMRQLIDAVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2582 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKTKRKPPSTNAGRRQKHRLTCPSCDSYEKKPPKEFLERFKSLLQKMIHQHLSSRTHGSEDS

SEQ ID NO: 2583 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKFKRKPPSTNAGQDQKHRLTCPSCDSYEKKPPKEFLERFKSLLQKMIHQHLSSRTHGSEDS

SEQ ID NO: 2584 - protein, 162 aa, synthetic construct
MRSSPGNMERIVICLMVIFLGTLVHKSSSQGQDRHMIRARQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 2585 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINEKIKKLKRKVPSTNAGRRQKHRLTCPSCDSYEKKPPKEFLERFKSLLQKMIHQHLSSRTHGSEDS

SEQ ID NO: 2586 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAISCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2587 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFWDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2588 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKYKPPSDNAGRRQKHRLTCPSCDSYEKKPPKEFLERFKSLLQKMIHQHLSSRTHGSEDS

SEQ ID NO: 2589 - protein, 162 aa, synthetic construct
MRSSPGNMERIVICLMVIFLGTLVHKSSSQGQDRHMIRMRQLIDGVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2590 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKRKGPSTNAGRRQKHRLTCPSCDSYEKKPPKEFLERFKSLLQKMIHQHLSSRTHGSEDS

SEQ ID NO: 2591 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINRSIKKLKRKPPSDNAGRRQKHRLTCPSCDSYEKKPPKEFLERFKSLLQKMIHQHLSSRTHGSEDS

SEQ ID NO: 2592 - protein, 162 aa, synthetic construct
MRSSPGNMERIVICLMVIFLGTLVHKSSSQGQDRFMIRMRQLIYIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2593 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKRPSTNAGRRQKHRLTCPSCDSYEKKPPKEFLERFKSLLQKMIHQHLSSRTHGSEDS

SEQ ID NO: 2594 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFDDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2595 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKLKPPSDNAGRRQKHRLTCPSCDSYEKKPPKEFLERFKSLLQKMIHQHLSSRTHGSEDS

SEQ ID NO: 2596 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAKSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2597 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKAPSTNAGQDQKHRLTCPSCDSYEKKPPKEFLERFKSLLQKMIHQHLSSRTHGSEDS

SEQ ID NO: 2598 - protein, 162 aa, synthetic construct
MRSSPGNMERIVICLMVIFLGTLVHKSSSQGQDRHMIRMRDLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2599 - protein, 162 aa, synthetic construct
MRSSPGNMERIVICLMVIFLGTLVHKSSSQGQDRHMIAMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 2600 - protein, 162 aa, synthetic construct
MRSSPGNMERIVICLMVIFLGTLVHKSSSQGQDRHMGRMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2601 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLPRKPPSTNAGQDQKHRLTCPSCDSYEKKPPKEFLERFKSLLQKMIHQHLSSRTHGSEDS

SEQ ID NO: 2602 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKVKSTNAGRRQKHRLTCPSCDSYEKKPPKEFLERFKSLLQKMIHQHLSSRTHGSEDS

SEQ ID NO: 2603 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKYKVPSTNAGQDQKHRLTCPSCDSYEKKPPKEFLERFKSLLQKMIHQHLSSRTHGSEDS

SEQ ID NO: 2604 - protein, 162 aa, synthetic construct
MRSSPGNMERIVICLMVIFLGTLVHKSSSQGQDRHMIRMRQLIFIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2605 - protein, 162 aa, synthetic construct
MRSSPGNMERIVICLMVIFLGTLVHKSSSQGQDRHMIRMRQLIFIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2606 - protein, 162 aa, synthetic construct
MRSSPGNMERIVICLMVIFLGTLVHKSSSQGQDRHMIQMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2607 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINHSIKKLKRKPPSTNAGRRQKHRLTCPSCDSYEKKPPKEFLERFKSLLQKMIHQHLSSRTHGSEDS

SEQ ID NO: 2608 - protein, 162 aa, synthetic construct
MRSSPGNMERIVICLMVIFLGTLVHKSSSQGQDYHMIRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2609 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAFLKSANTGNNERIINESIKKLKRKVPSTNAGRRQKHRLTCPSCDSYEKKPPKEFLERFKSLLQKMIHQHLSSRTHGSEDS

SEQ ID NO: 2610 - protein, 162 aa, synthetic construct
MRSSPGNMERIVICLMVIFLGTLVHKSSSQGQDRFMIRMRQLIDIVDQFKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2611 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINYSIKKLKRKVPSTNAGRRQKHRLTCPSCDSYEKKPPKEFLERFKSLLQKMIHQHLSSRTHGSEDS

SEQ ID NO: 2612 - protein, 162 aa, synthetic construct
MRSSPGNMERIVICLMVIFLGTLVHKSSSQGQDHHMIRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2613 - protein, 162 aa, synthetic construct
MRSSPGNMERIVICLMVIFLGTLVHKSSSQGQDDHMIRMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2614 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKYKVPSTNAGRRQKHRLTCPSCDSYEKKPPKEFLERFKSLLQKMIHQHLSSRTHGSEDS

SEQ ID NO: 2615 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFHDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2616 - protein, 162 aa, synthetic construct
MRSSPGNMERIVICLMVIFLGTLVHKSSSQGQDRFMIRMRQLIPIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2617 - protein, 162 aa, synthetic construct
MRSSPGNMERIVICLMVIFLGTLVHKSSSQGQDRHMIRMRQLIGIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2618 - protein, 162 aa, synthetic construct
MRSSPGNMERIVICLMVIFLGTLVHKSSSQGQDAHMIRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2619 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLPSANTGNNERIINVSIKKLKRKPPSTNAGQDQKHRLTCPSCDSYEKKPPKEFLERFKSLLQKMIHQHLSSRTHGSEDS

SEQ ID NO: 2620 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKLLKRKPPSTNAGRRQKHRLTCPSCDSYEKKPPKEFLERFKSLLQKMIHQHLSSRTHGSEDS

SEQ ID NO: 2621 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKRGPPSTNAGRRQKHRLTCPSCDSYEKKPPKEFLERFKSLLQKMIHQHLSSRTHGSEDS

SEQ ID NO: 2622 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINERIKKLKRKVPSTNAGRRQKHRLTCPSCDSYEKKPPKEFLERFKSLLQKMIHQHLSSRTHGSEDS

SEQ ID NO: 2623 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKRKPESTNAGRRQKHRLTCPSCDSYEKKPPKEFLERFKSLLQKMIHQHLSSRTHGSEDS

SEQ ID NO: 2624 - protein, 162 aa, synthetic construct
MRSSPGNMERIVICLMVIFLGTLVHKSSSQGQDRHMIRMRQLITTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2625 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKRKPYSTNAGRRQKHRLTCPSCDSYEKKPPKEFLERFKSLLQKMIHQHLSSRTHGSEDS

SEQ ID NO: 2626 - protein, 162 aa, synthetic construct
MRSSPGNMERIVICLMVIFLGTLVHKSSSQGQDRHMIRMRQLIYIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2627 - protein, 162 aa, synthetic construct
MRSSPGNMERIVICLMVIFLGTLVHKSSSQGQDRHMFRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2628 - protein, 162 aa, synthetic construct; identical to SEQ ID NO: 1958

SEQ ID NO: 2629 - protein, 162 aa, synthetic construct
MRSSPGNMERIVICLMVIFLGTLVHKSSSQGQDRFMIKMRQLIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2630 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQRAQLKSANTGNNERIINESIKKLKRKPPSTNAGRRQKHRLTCPSCDSYEKKPPKEFLERFKSLLQKMIHQHLSSRTHGSEDS

SEQ ID NO: 2631 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTQNNERIINVSIKKLKRKVPSTNAGQDQKHRLTCPSCDSYEKKPPKEFLERFKSLLQKMIHQHLSSRTHGSEDS

SEQ ID NO: 2632 - protein, 162 aa, synthetic construct
MRSSPGNMERIVICLMVIFLGTLVHKSSSQGQDRHMIRMRQLIATVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2633 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKLKVPSTNAGRRQKHRLTCPSCDSYEKKPPKEFLERFKSLLQKMIHQHLSSRTHGSEDS

SEQ ID NO: 2634 - protein, 162 aa, synthetic construct
MRSSPGNMERIVICLMVIFLGTLVHKSSSQGQDRFMIRMRQKIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2635 - protein, 162 aa, synthetic construct
MRSSPGNMERIVICLMVIFLGTLVHKSSSQGQDRHMIMMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2636 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKLKVPSTNAGQDQKHRLTCPSCDSYEKKPPKEFLERFKSLLQKMIHQHLSSRTHGSEDS

SEQ ID NO: 2637 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQRAQLKSANTGNNERIINESIKKLKRKVPSTNAGRRQKHRLTCPSCDSYEKKPPKEFLERFKSLLQKMIHQHLSSRTHGSEDS

SEQ ID NO: 2638 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQPKSANTGNNERIINVSIKKLKRKPPSTNAGQDQKHRLTCPSCDSYEKKPPKEFLERFKSLLQKMIHQHLSSRTHGSEDS

SEQ ID NO: 2639 - protein, 162 aa, synthetic construct
MRSSPGNMERIVICLMVIFLGTLVHKSSSQGQDRHMIWMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2640 - protein, 162 aa, synthetic construct
MRSSPGNMERIVICLMVIFLGTLVHKSSSQGQDRHMGRMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 2641 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVKIKKLKRKPPSTNAGQDQKHRLTCPSCDSYEKKPPKEFLERFKSLLQKMIHQHLSSRTHGSEDS

SEQ ID NO: 2642 - protein, 162 aa, synthetic construct
MRSSPGNMERIVICLMVIFLGTLVHKSSSQGQDRHMRRMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2643 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKKKPPSTNAGQDQKHRLTCPSCDSYEKKPPKEFLERFKSLLQKMIHQHLSSRTHGSEDS

SEQ ID NO: 2644 - protein, 162 aa, synthetic construct
MRSSPGNMERIVICLMVIFLGTLVHKSSSQGQDRHMHRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2645 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKRKKPSTNAGRRQKHRLTCPSCDSYEKKPPKEFLERFKSLLQKMIHQHLSSRTHGSEDS

SEQ ID NO: 2646 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTQNNERIINVSIKKLKRKPPSDNPGRRQKHRLTCPSCDSYEKKPPKEFLERFKSLLQKMIHQHLSSRTHGSEDS

SEQ ID NO: 2647 - protein, 162 aa, synthetic construct
MRSSPGNMERIVICLMVIFLGTLVHKSSSQGQDRFMIRMRQLIDWVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2648 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIPNESIKKLKRKPPSDNAGRRQKHRLTCPSCDSYEKKPPKEFLERFKSLLQKMIHQHLSSRTHGSEDS

SEQ ID NO: 2649 - protein, 162 aa, synthetic construct
MRSSPGNMERIVICLMVIFLGTLVHKSSSQGQDRFMIMMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2650 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIANVSIKKLKRKPPSTNAGQDQKHRLTCPSCDSYEKKPPKEFLERFKSLLQKMIHQHLSSRTHGSEDS

SEQ ID NO: 2651 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSARTGNNERIINVSIKKLKRKPPSDNPGRRQKHRLTCPSCDSYEKKPPKEFLERFKSLLQKMIHQHLSSRTHGSEDS

SEQ ID NO: 2652 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSDNPHRRQKHRLTCPSCDSYEKKPPKEFLERFKSLLQKMIHQHLSSRTHGSEDS

SEQ ID NO: 2653 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKHKVPSTNAGRRQKHRLTCPSCDSYEKKPPKEFLERFKSLLQKMIHQHLSSRTHGSEDS

SEQ ID NO: 2654 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSDKPGRRQKHRLTCPSCDSYEKKPPKEFLERFKSLLQKMIHQHLSSRTHGSEDS

SEQ ID NO: 2655 - protein, 162 aa, synthetic construct
MRSSPGNMERIVICLMVIFLGTLVHKSSSQGQDRHMIRMRQLIDWVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2656 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDLQLKSANTGNNERIINVSIKKLKRKPPSTNAGQDQKHRLTCPSCDSYEKKPPKEFLERFKSLLQKMIHQHLSSRTHGSEDS

SEQ ID NO: 2657 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIENVSIKKLKRKPPSTNAGQDQKHRLTCPSCDSYEKKPPKEFLERFKSLLQKMIHQHLSSRTHGSEDS

SEQ ID NO: 2658 - protein, 162 aa, synthetic construct
MRSSPGNMERIVICLMVIFLGTLVHKSSSQGQDRIMPRMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2659 - protein, 162 aa, synthetic construct
MRSSPGNMERIVICLMVIFLGTLVHKSSSQGQDRFMIRMRQLIDIVDQLKNYVNDLVPEFLPAPEDVETNCEWSATSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2660 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNGERIINVSIKKLKRKPPSDNPGRRQKHRLTCPSCDSYEKKPPKEFLERFKSLLQKMIHQHLSSRTHGSEDS

SEQ ID NO: 2661 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKRKRPSTNAGRRQKHRLTCPSCDSYEKKPPKEFLERFKSLLQKMIHQHLSSRTHGSEDS

SEQ ID NO: 2662 - protein, 162 aa, synthetic construct
MRSSPGNMERIVICLMVIFLGTLVHKSSSQGQDRFMIRMRQLIDIVDQLKNYVNDLVPEFLPAPEDVETNCEWSARSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2663 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPMSDNPGRRQKHRLTCPSCDSYEKKPPKEFLERFKSLLQKMIHQHLSSRTHGSEDS

SEQ ID NO: 2664 - protein, 162 aa, synthetic construct
MRSSPGNMERIVICLMVIFLGTLVHKSSSQGQDRFMIKMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2665 - protein, 162 aa, synthetic construct
MRSSPGNMERIVICLMVIFLGTLVHKSSSQGQDRIMIWMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2666 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSSNPGRRQKHRLTCPSCDSYEKKPPKEFLERFKSLLQKMIHQHLSSRTHGSEDS

SEQ ID NO: 2667 - protein, 162 aa, synthetic construct
MRSSPGNMERIVICLMVIFLGTLVHKSSSQGQDRHMIRMRQLIDTVDKLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2668 - protein, 162 aa, synthetic construct
MRSSPGNMERIVICLMVIFLGTLVHKSSSQGQDRHMRRMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 2669 - protein, 162 aa, synthetic construct
MRSSPGNMERIVICLMVIFLGTLVHKSSSQGQDRHMIKMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2670 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNSRIINVSIKKLKRKPPSDNPGRRQKHRLTCPSCDSYEKKPPKEFLERFKSLLQKMIHQHLSSRTHGSEDS

SEQ ID NO: 2671 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSDNPGRRQKHRSTCPSCDSYEKKPPKEFLERFKSLLQKMIHQHLSSRTHGSEDS

SEQ ID NO: 2672 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNTRIINVSIKKLKRKPPSDNPGRRQKHRLTCPSCDSYEKKPPKEFLERFKSLLQKMIHQHLSSRTHGSEDS

SEQ ID NO: 2673 - protein, 162 aa, synthetic construct
MRSSPGNMERIVICLMVIFLGTLVHKSSSQGQDRIMQRMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2674 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKLKPPSTNAGRRQKHRLTCPSCDSYEKKPPKEFLERFKSLLQKMIHQHLSSRTHGSEDS

SEQ ID NO: 2675 - protein, 162 aa, synthetic construct
MRSSPGNMERIVICLMVIFLGTLVHKSSSQGQDRIMIRMRQLIDIVDQLKNYVNDFVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2676 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPNSDNPGRRQKHRLTCPSCDSYEKKPPKEFLERFKSLLQKMIHQHLSSRTHGSEDS

SEQ ID NO: 2677 - protein, 162 aa, synthetic construct
MRSSPGNMERIVICLMVIFLGTLVHKSSSQGQDRHMIRMRQLIDIVDQLKNYVNDLVPEFLPAPRDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2678 - protein, 162 aa, synthetic construct
MRSSPGNMERIVICLMVIFLGTLVHKSSSQGQDRIMIRMRQLIDIVDQLKNYVNDLVPVFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2679 - protein, 162 aa, synthetic construct
MRSSPGNMERIVICLMVIFLGTLVHKSSSQGQDRHMIRMRQLIQIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2680 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSHNAGRRQKHRLTCPSCDSYEKKPPKEFLERFKSLLQKMIHQHLSSRTHGSEDS

SEQ ID NO: 2681 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKMANTGNNERIINVSIKKLKRKPPSDNPGRRQKHRLTCPSCDSYEKKPPKEFLERFKSLLQKMIHQHLSSRTHGSEDS

SEQ ID NO: 2682 - protein, 162 aa, synthetic construct
MRSSPGNMERIVICLMVIFLGTLVHKSSSQGQDRFMIAMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2683 - protein, 162 aa, synthetic construct
MRSSPGNMERIVICLMVIFLGTLVHKSSSQGQDRHMIRMRQLIDIVDQLKNYVNDLVPYFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2684 - protein, 162 aa, synthetic construct
MRSSPGNMERIVICLMVIFLGTLVHKSSSQGQDRHMIRMRQLISTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2685 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSNNPGRRQKHRLTCPSCDSYEKKPPKEFLERFKSLLQKMIHQHLSSRTHGSEDS

SEQ ID NO: 2686 - protein, 162 aa, synthetic construct
MRSSPGNMERIVICLMVIFLGTLVHKSSSQGQDRHMIRMRQLIDIVDQLKNYVNYLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2687 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIYNESIKKLKRKPPSDNAGRRQKHRLTCPSCDSYEKKPPKEFLERFKSLLQKMIHQHLSSRTHGSEDS

SEQ ID NO: 2688 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLMQKMIHQHLSSRTHGSEDS

SEQ ID NO: 2689 - protein, 162 aa, synthetic construct
MRSSPGNMERIVICLMVIFLGTLVHKSSSQGQWRHMIRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2690 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKTQLKSANTGNNERIINVSIKKLKRKPPSDNPGRRQKHRLTCPSCDSYEKKPPKEFLERFKSLLQKMIHQHLSSRTHGSEDS

SEQ ID NO: 2691 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAKLKSANTGNNERIINVSIKKLKRKPPSTNAGRRQKHRLTCPSCDSYEKKPPKEFLERFKSLLQKMIHQHLSSRTHGSEDS

SEQ ID NO: 2692 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFAKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2693 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNVRIINVSIKKLKRKPPSTNAGRRQKHRLTCPSCDSYEKKPPKEFLERFKSLLQKMIHQHLSSRTHGSEDS

SEQ ID NO: 2694 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKIKRKPPSTNAGRRQKHRLTCPSCDSYEKKPPKEFLERFKSLLQKMIHQHLSSRTHGSEDS

SEQ ID NO: 2695 - protein, 162 aa, synthetic construct
MRSSPGNMERIVICLMVIFLGTLVHKSSSQGQDRHMIRMRQLIDIVDQLKNHVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2696 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTINNERIINVSIKKLKRKPPSTNAGRRQKHRLTCPSCDSYEKKPPKEFLERFKSLLQKMIHQHLSSRTHGSEDS

SEQ ID NO: 2697 - protein, 162 aa, synthetic construct
MRSSPGNMERIVICLMVIFLGTLVHKSSSQGQDRFMIRMRWLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2698 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKMKPPSDNAGRRQKHRLTCPSCDSYEKKPPKEFLERFKSLLQKMIHQHLSSRTHGSEDS

SEQ ID NO: 2699 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESRKKLKRKPPSTNAGRRQKHRLTCPSCDSYEKKPPKEFLERFKSLLQKMIHQHLSSRTHGSEDS

SEQ ID NO: 2700 - protein, 162 aa, synthetic construct
MRSSPGNMERIVICLMVIFLGTLVHKSSSQGQDRHMIRMRQLIDIVDQLKNYVNMLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2701 - protein, 162 aa, synthetic construct
MRSSPGNMERIVICLMVIFLGTLVHKSSSQGQDRHMIRMRQLIDIVDQLKNYVNDLVPEFLPAPEKVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2702 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFSDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2703 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSPNTGNNERIINVSIKKLKRKPPSTNAGRRQKHRLTCPSCDSYEKKPPKEFLERFKSLLQKMIHQHLSSRTHGSEDS

SEQ ID NO: 2704 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSDNRGRRQKHRLTCPSCDSYEKKPPKEFLERFKSLLQKMIHQHLSSRTHGSEDS

SEQ ID NO: 2705 - protein, 162 aa, synthetic construct
MRSSPGNMERIVICLMVIFLGTLVHKSSSQGQDRHRIRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2706 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNYERIINVSIKKLKRKPPSDNPGRRQKHRLTCPSCDSYEKKPPKEFLERFKSLLQKMIHQHLSSRTHGSEDS

SEQ ID NO: 2707 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKSKRKPPSTNAGRRQKHRLTCPSCDSYEKKPPKEFLERFKSLLQKMIHQHLSSRTHGSEDS

SEQ ID NO: 2708 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFKCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2709 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFAKAQLKSANTGNNERIINVSIKKLKRKVPSTNAGQDQKHRLTCPSCDSYEKKPPKEFLERFKSLLQKMIHQHLSSRTHGSEDS

SEQ ID NO: 2710 - protein, 162 aa, synthetic construct
MRSSPGNMERIVICLMVIFLGTLVHKSSSQGQDRHMIRMRQLIDIVDQLKNYVNDLVPEFLPAPEDVGTGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2711 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPLSTNAGRRQKHRLTCPSCDSYEKKPPKEFLERFKSLLQKMIHQHLSSRTHGSEDS

SEQ ID NO: 2712 - protein, 162 aa, synthetic construct
MRSSPGNMERIVICLMVIFLGTLVHKSSSQGQDRHMIRMRQLIDIVDQLKNYVNDLVPEFLPAPEDVETGCTWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2713 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSDNPRRRQKHRLTCPSCDSYEKKPPKEFLERFKSLLQKMIHQHLSSRTHGSEDS

SEQ ID NO: 2714 - protein, 162 aa, synthetic construct
MRSSPGNMERIVICLMVIFLGTLVHKSSSQGQDRHMKRMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 2715 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRHPPSTNAGRRQKHRLTCPSCDSYEKKPPKEFLERFKSLLQKMIHQHLSSRTHGSEDS

SEQ ID NO: 2716 - protein, 162 aa, synthetic construct
MRSSPGNMERIVICLMVIFLGTLVHKSSSQGQVRHMIRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2717 - protein, 162 aa, synthetic construct
MRSSPGNMERIVICLMVIFLGTLVHKSSSQGQTRHMIRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2718 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPYSTNAGRRQKHRLTCPSCDSYEKKPPKEFLERFKSLLQKMIHQHLSSRTHGSEDS

SEQ ID NO: 2719 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKRKPWSTNAGRRQKHRLTCPSCDSYEKKPPKEFLERFKSLLQKMIHQHLSSRTHGSEDS

SEQ ID NO: 2720 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINPSIKKLKRKVPSTNAGRRQKHRLTCPSCDSYEKKPPKEFLERFKSLLQKMIHQHLSSRTHGSEDS

SEQ ID NO: 2721 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNSRIINVSIKKLKRKPPSTNAGRRQKHRLTCPSCDSYEKKPPKEFLERFKSLLQKMIHQHLSSRTHGSEDS

SEQ ID NO: 2722 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKAKRKVPSTNAGRRQKHRLTCPSCDSYEKKPPKEFLERFKSLLQKMIHQHLSSRTHGSEDS

SEQ ID NO: 2723 - protein, 162 aa, synthetic construct
MRSSPGNMERIVICLMVIFLGTLVHKSSSQGQDRIMIRMRQLIDIVDQLKNYMNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2724 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKRKKPSTNAGRRQKHRLTCPSCDSYEKKPPKEFLERFKSLLQKMIHQHLSSRTHGSEDS

SEQ ID NO: 2725 - protein, 162 aa, synthetic construct
MRSSPGNMERIVICLMVIFLGTLVHKSSSQGQDRHMIRMRQLYDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2726 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDYQLKSANTGNNERIINVSIKKLKRKPPSTNAGQDQKHRLTCPSCDSYEKKPPKEFLERFKSLLQKMIHQHLSSRTHGSEDS

SEQ ID NO: 2727 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNWERIINVSIKKLKRKPPSTNAGRRQKHRLTCPSCDSYEKKPPKEFLERFKSLLQKMIHQHLSSRTHGSEDS

SEQ ID NO: 2728 - protein, 162 aa, synthetic construct
MRSSPGNMERIVICLMVIFLGTLVHKSSSQGQDRIMIRMRQLIQIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2729 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFNKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2730 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKDLKRKPPSTNAGRRQKHRLTCPSCDSYEKKPPKEFLERFKSLLQKMIHQHLSSRTHGSEDS

SEQ ID NO: 2731 - protein, 162 aa, synthetic construct
MRSSPGNMERIVICLMVIFLGTLVHKSSSQGQDRHMIRMRQLIDIVDQLKNYVNDLVPEFLPAPEDVETGCEWSATSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2732 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQSAQLKSANTGNNERIINVSIKKLKRKPPSTNAGRRQKHRLTCPSCDSYEKKPPKEFLERFKSLLQKMIHQHLSSRTHGSEDS

SEQ ID NO: 2733 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFRCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2734 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKGPSDNPGRRQKHRLTCPSCDSYEKKPPKEFLERFKSLLQKMIHQHLSSRTHGSEDS

SEQ ID NO: 2735 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKMKVPSTNAGRRQKHRLTCPSCDSYEKKPPKEFLERFKSLLQKMIHQHLSSRTHGSEDS

SEQ ID NO: 2736 - protein, 162 aa, synthetic construct
MRSSPGNMERIVICLMVIFLGTLVHKSSSQGQDRIMIRMRQLIVIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2737 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFWCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2738 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVGIKKLKRKPPSDNPGRRQKHRLTCPSCDSYEKKPPKEFLERFKSLLQKMIHQHLSSRTHGSEDS

SEQ ID NO: 2739 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSSKKLKRKPPSTNAGQDQKHRLTCPSCDSYEKKPPKEFLERFKSLLQKMIHQHLSSRTHGSEDS

SEQ ID NO: 2740 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKVLKRKPPSTNAGRRQKHRLTCPSCDSYEKKPPKEFLERFKSLLQKMIHQHLSSRTHGSEDS

SEQ ID NO: 2741 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSARTGNNERIINVSIKKLKRKPPSTNAGRRQKHRLTCPSCDSYEKKPPKEFLERFKSLLQKMIHQHLSSRTHGSEDS

SEQ ID NO: 2742 - protein, 162 aa, synthetic construct
MRSSPGNMERIVICLMVIFLGTLVHKSSSQGQDRIMERMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2743 - protein, 162 aa, synthetic construct
MRSSPGNMERIVICLMVIFLGTLVHKSSSQGQDRHMIRMRQLIDIVDQLKNYVNDLVPEFLPAPEDVETGCEWKAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2744 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINFSIKKLKRKPPSDNPGRRQKHRLTCPSCDSYEKKPPKEFLERFKSLLQKMIHQHLSSRTHGSEDS

SEQ ID NO: 2745 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNIRIINVSIKKLKRKPPSTNAGRRQKHRLTCPSCDSYEKKPPKEFLERFKSLLQKMIHQHLSSRTHGSEDS

SEQ ID NO: 2746 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAHLKSANTGNNERIINVSIKKLKRKPPSTNAGRRQKHRLTCPSCDSYEKKPPKEFLERFKSLLQKMIHQHLSSRTHGSEDS

SEQ ID NO: 2747 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIQNESIKKLKRKPPSTNAGRRQKHRLTCPSCDSYEKKPPKEFLERFKSLLQKMIHQHLSSRTHGSEDS

SEQ ID NO: 2748 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIENESIKKLKRKPPSDNAGRRQKHRLTCPSCDSYEKKPPKEFLERFKSLLQKMIHQHLSSRTHGSEDS

SEQ ID NO: 2749 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERGINVSIKKLKRKPPSTNAGRRQKHRLTCPSCDSYEKKPPKEFLERFKSLLQKMIHQHLSSRTHGSEDS

SEQ ID NO: 2750 - protein, 162 aa, synthetic construct
MRSSPGNMERIVICLMVIFLGTLVHKSSSQGQDRIMWRMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2751 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINHSIKKLKRKVPSTNAGRRQKHRLTCPSCDSYEKKPPKEFLERFKSLLQKMIHQHLSSRTHGSEDS

SEQ ID NO: 2752 - protein, 162 aa, synthetic construct
MRSSPGNMERIVICLMVIFLGTLVHKSSSQGQDRHMIRMRQLIDIVDQLKNYVNDLVPEFLPAPEDLETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2753 - protein, 162 aa, synthetic construct
MRSSPGNMERIVICLMVIFLGTLVHKSSSQGQDRHMIRMRQLIDIVDQLKNYVNDLVPEFLPAPEDVETGCEKSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2754 - protein, 162 aa, synthetic construct
MRSSPGNMERIVICLMVIFLGTLVHKSSSQGQDRHMIRMRQLFDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2755 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKHPSTNAGRRQKHRLTCPSCDSYEKKPPKEFLERFKSLLQKMIHQHLSSRTHGSEDS

SEQ ID NO: 2756 - protein, 162 aa, synthetic construct
MRSSPGNMERIVICLMVIFLGTLVHKSSSQGQDRHMIRMRQLIDIVDQLKNYVNDLVPEFLPAPEDVETPCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2757 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQMAQLKSANTGNNERIINVSIKKLKRKPPSTNAGRRQKHRLTCPSCDSYEKKPPKEFLERFKSLLQKMIHQHLSSRTHGSEDS

SEQ ID NO: 2758 - protein, 162 aa, synthetic construct
MRSSPGNMERIVICLMVIFLGTLVHKSSSQGQDRHMIRMRQLIDIVDQLKNYVNDSVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2759 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINKSIKKLKRKVPSTNAGQDQKHRLTCPSCDSYEKKPPKEFLERFKSLLQKMIHQHLSSRTHGSEDS

SEQ ID NO: 2760 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNYRIINVSIKKLKRKPPSTNAGRRQKHRLTCPSCDSYEKKPPKEFLERFKSLLQKMIHQHLSSRTHGSEDS

SEQ ID NO: 2761 - protein, 162 aa, synthetic construct
MRSSPGNMERIVICLMVIFLGTLVHKSSSQGQDRIMSRMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2762 - protein, 162 aa, synthetic construct
MRSSPGNMERIVICLMVIFLGTLVHKSSSQGQDRIMDRMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2763 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFEDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2764 - protein, 162 aa, synthetic construct
MRSSPGNMERIVICLMVIFLGTLVHKSSSQGQDRFMIRPRQLIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2765 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNTRIINVSIKKLKRKPPSTNAGRRQKHRLTCPSCDSYEKKPPKEFLERFKSLLQKMIHQHLSSRTHGSEDS

SEQ ID NO: 2766 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKFKVPSTNAGQDQKHRLTCPSCDSYEKKPPKEFLERFKSLLQKMIHQHLSSRTHGSEDS

SEQ ID NO: 2767 - protein, 162 aa, synthetic construct
MRSSPGNMERIVICLMVIFLGTLVHKSSSQGQDRIMIRMRQLIAIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2768 - protein, 162 aa, synthetic construct
MRSSPGNMERIVICLMVIFLGTLVHKSSSQGQDRHMIRMRQLIDWVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2769 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKYPSDNPGRRQKHRLTCPSCDSYEKKPPKEFLERFKSLLQKMIHQHLSSRTHGSEDS

SEQ ID NO: 2770 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNKGRRQKHRLTCPSCDSYEKKPPKEFLERFKSLLQKMIHQHLSSRTHGSEDS

SEQ ID NO: 2771 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFIKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2772 - protein, 162 aa, synthetic construct
MRSSPGNMERIVICLMVIFLGTLVHKSSSQGQDRHMIRMRQLIDSVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2773 - protein, 162 aa, synthetic construct
MRSSPGNMERIVICLMVIFLGTLVHKSSSQGQDRHMIRMRQLIDIVDKLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2774 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTKNNERIINVSIKKLKRKPPSTNAGRRQKHRLTCPSCDSYEKKPPKEFLERFKSLLQKMIHQHLSSRTHGSEDS

SEQ ID NO: 2775 - protein, 162 aa, synthetic construct
MRSSPGNMERIVICLMVIFLGTLVHKSSSQGQDRHMIRMRQLISIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2776 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFNDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2777 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKKKVPSTNAGRRQKHRLTCPSCDSYEKKPPKEFLERFKSLLQKMIHQHLSSRTHGSEDS

SEQ ID NO: 2778 - protein, 162 aa, synthetic construct
MRSSPGNMERIVICLMVIFLGTLVHKSSSQGQDRIMIRMRQLITIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2779 - protein, 162 aa, synthetic construct
MRSSPGNMERIVICLMVIFLGTLVHKSSSQGQDRIMIRMRQLIMIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2780 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKLKPPSDNPGRRQKHRLTCPSCDSYEKKPPKEFLERFKSLLQKMIHQHLSSRTHGSEDS

SEQ ID NO: 2781 - protein, 162 aa, synthetic construct
MRSSPGNMERIVICLMVIFLGTLVHKSSSQGQDRFMIRMRQKIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2782 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPASTNAGRRQKHRLTCPSCDSYEKKPPKEFLERFKSLLQKMIHQHLSSRTHGSEDS

SEQ ID NO: 2783 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPYSDNPGRRQKHRLTCPSCDSYEKKPPKEFLERFKSLLQKMIHQHLSSRTHGSEDS

SEQ ID NO: 2784 - protein, 162 aa, synthetic construct
MRSSPGNMERIVICLMVIFLGTLVHKSSSQGQDRHMIRMRQLIDIVDQLKNYVNDLVPEFLLAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2785 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQFAQLKSANTGNNERIINVSIKKLKRKPPSTNAGRRQKHRLTCPSCDSYEKKPPKEFLERFKSLLQKMIHQHLSSRTHGSEDS

SEQ ID NO: 2786 - protein, 162 aa, synthetic construct
MRSSPGNMERIVICLMVIFLGTLVHKSSSQGQDRHMFRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2787 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANFGNNERIINVSIKKLKRKPPSDNPGRRQKHRLTCPSCDSYEKKPPKEFLERFKSLLQKMIHQHLSSRTHGSEDS

SEQ ID NO: 2788 - protein, 162 aa, synthetic construct
MRSSPGNMERIVICLMVIFLGTLVHKSSSQGQDGHMIRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2789 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINRSIKKLKRKPPSTNAGRRQKHRLTCPSCDSYEKKPPKEFLERFKSLLQKMIHQHLSSRTHGSEDS

SEQ ID NO: 2790 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQAAQLKSANTGNNERIINVSIKKLKRKPPSTNAGRRQKHRLTCPSCDSYEKKPPKEFLERFKSLLQKMIHQHLSSRTHGSEDS

SEQ ID NO: 2791 - protein, 162 aa, synthetic construct
MRSSPGNMERIVICLMVIFLGTLVHKSSSQGQDRIMIRMRQLIDIVDQLKNNVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2792 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERISNESIKKLKRKPPSDNAGRRQKHRLTCPSCDSYEKKPPKEFLERFKSLLQKMIHQHLSSRTHGSEDS

SEQ ID NO: 2793 - protein, 162 aa, synthetic construct
MRSSPGNMERIVICLMVIFLGTLVHKSSSQGQDRHMIFMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2794 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFADAQLKSANTGNNERIINVSIKKLKRKPPSTNAGRRQKHRLTCPSCDSYEKKPPKEFLERFKSLLQKMIHQHLSSRTHGSEDS

SEQ ID NO: 2795 - protein, 162 aa, synthetic construct
MRSSPGNMERIVICLMVIFLGTLVHKSSSQGQDRHMIRMRQLINIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2796 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNRGRRQKHRLTCPSCDSYEKKPPKEFLERFKSLLQKMIHQHLSSRTHGSEDS

SEQ ID NO: 2797 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSHNPGRRQKHRLTCPSCDSYEKKPPKEFLERFKSLLQKMIHQHLSSRTHGSEDS

SEQ ID NO: 2798 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESDKKLKRKPPSDNAGRRQKHRLTCPSCDSYEKKPPKEFLERFKSLLQKMIHQHLSSRTHGSEDS

SEQ ID NO: 2799 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIIHVSIKKLKRKPPSTNAGRRQKHRLTCPSCDSYEKKPPKEFLERFKSLLQKMIHQHLSSRTHGSEDS

SEQ ID NO: 2800 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPPSTNARRRQKHRLTCPSCDSYEKKPPKEFLERFKSLLQKMIHQHLSSRTHGSEDS

SEQ ID NO: 2801 - protein, 162 aa, synthetic construct
MRSSPGNMERIVICLMVIFLGTLVHKSSSQGQDDIMIRMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2802 - protein, 162 aa, synthetic construct
MRSSPGNMERIVICLMVIFLGTLVHKSSSQGQDDHMIRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2803 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRSPPSTNAGRRQKHRLTCPSCDSYEKKPPKEFLERFKSLLQKMIHQHLSSRTHGSEDS

SEQ ID NO: 2804 - protein, 162 aa, synthetic construct
MRSSPGNMERIVICLMVIFLGTLVHKSSSQGQDRHMIRMRQLIDIVDQLKNYVNDLVPEFLPAPEDVETMCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2805 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKYKPPSDNPGRRQKHRLTCPSCDSYEKKPPKEFLERFKSLLQKMIHQHLSSRTHGSEDS

SEQ ID NO: 2806 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKHPSDNPGRRQKHRLTCPSCDSYEKKPPKEFLERFKSLLQKMIHQHLSSRTHGSEDS

SEQ ID NO: 2807 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTINNERIINVSIKKLKRKPPSDNPGRRQKHRLTCPSCDSYEKKPPKEFLERFKSLLQKMIHQHLSSRTHGSEDS

SEQ ID NO: 2808 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNWERIINVSIKKLKRKPPSDNPGRRQKHRLTCPSCDSYEKKPPKEFLERFKSLLQKMIHQHLSSRTHGSEDS

SEQ ID NO: 2809 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFVDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2810 - protein, 162 aa, synthetic construct
MRSSPGNMERIVICLMVIFLGTLVHKSSSQGQDRHMIKMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2811 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQIAQLKSANTGNNERIINVSIKKLKRKPPSTNAGRRQKHRLTCPSCDSYEKKPPKEFLERFKSLLQKMIHQHLSSRTHGSEDS

SEQ ID NO: 2812 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQQAQLKSANTGNNERIINVSIKKLKRKPPSTNAGRRQKHRLTCPSCDSYEKKPPKEFLERFKSLLQKMIHQHLSSRTHGSEDS

SEQ ID NO: 2813 - protein, 162 aa, synthetic construct
MRSSPGNMERIVICLMVIFLGTLVHKSSSQGQDRHMIGMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 2814 - protein, 162 aa, synthetic construct
MRSSPGNMERIVICLMVIFLGTLVHKSSSQGQDRHPIRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2815 - protein, 162 aa, synthetic construct
MRSSPGNMERIVICLMVIFLGTLVHKSSSQGQDRHMPRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2816 - protein, 162 aa, synthetic construct
MRSSPGNMERIVICLMVIFLGTLVHKSSSQGQDRFMIRMRRLIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2817 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPWSDNPGRRQKHRLTCPSCDSYEKKPPKEFLERFKSLLQKMIHQHLSSRTHGSEDS

SEQ ID NO: 2818 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDVQLKSANTGNNERIINVSIKKLKRKPPSTNAGRRQKHRLTCPSCDSYEKKPPKEFLERFKSLLQKMIHQHLSSRTHGSEDS

SEQ ID NO: 2819 - protein, 162 aa, synthetic construct
MRSSPGNMERIVICLMVIFLGTLVHKSSSQGQDRHMIRMRQLIWTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2820 - protein, 162 aa, synthetic construct
MRSSPGNMERIVICLMVIFLGTLVHKSSSQGQDRHMIRMRQLIDIVDQLKNYVNDLVPEFLPAPEDVETGCEWRAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2821 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFEKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2822 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPGSTNAGRRQKHRLTCPSCDSYEKKPPKEFLERFKSLLQKMIHQHLSSRTHGSEDS

SEQ ID NO: 2823 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIIWVSIKKLKRKPPSDNPGRRQKHRLTCPSCDSYEKKPPKEFLERFKSLLQKMIHQHLSSRTHGSEDS

SEQ ID NO: 2824 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNPERIINVSIKKLKRKPPSDNPGRRQKHRLTCPSCDSYEKKPPKEFLERFKSLLQKMIHQHLSSRTHGSEDS

SEQ ID NO: 2825 - protein, 162 aa, synthetic construct
MRSSPGNMERIVICLMVIFLGTLVHKSSSQGQDRHMIRMRQLIDIVGQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2826 - protein, 162 aa, synthetic construct
MRSSPGNMERIVICLMVIFLGTLVHKSSSQGQDRHMIRMRQLIDIVDQLKNYVNDLVPEFLPAPEDVETGCRWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2827 - protein, 162 aa, synthetic construct
MRSSPGNMERIVICLMVIFLGTLVHKSSSQGQDRIMIRMRQLILIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2828 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFMKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2829 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAVLKSANTGNNERIINVSIKKLKRKPPSTNAGRRQKHRLTCPSCDSYEKKPPKEFLERFKSLLQKMIHQHLSSRTHGSEDS

SEQ ID NO: 2830 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQLAQLKSANTGNNERIINVSIKKLKRKPPSTNAGRRQKHRLTCPSCDSYEKKPPKEFLERFKSLLQKMIHQHLSSRTHGSEDS

SEQ ID NO: 2831 - protein, 162 aa, synthetic construct
MRSSPGNMERIVICLMVIFLGTLVHKSSSQGQDRHMIRMRQLITIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2832 - protein, 162 aa, synthetic construct
MRSSPGNMERIVICLMVIFLGTLVHKSSSQGQDRHMIRMRQLILIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2833 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIMNVSIKKLKRKPPSTNAGRRQKHRLTCPSCDSYEKKPPKEFLERFKSLLQKMIHQHLSSRTHGSEDS

SEQ ID NO: 2834 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKFKPPSTNAGRRQKHRLTCPSCDSYEKKPPKEFLERFKSLLQKMIHQHLSSRTHGSEDS

SEQ ID NO: 2835 - protein, 162 aa, synthetic construct
MRSSPGNMERIVICLMVIFLGTLVHKSSSQGQDRIMARMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2836 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKHKPPSDNAGRRQKHRLTCPSCDSYEKKPPKEFLERFKSLLQKMIHQHLSSRTHGSEDS

SEQ ID NO: 2837 - protein, 162 aa, synthetic construct
MRSSPGNMERIVICLMVIFLGTLVHKSSSQGQDRFMILMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2838 - protein, 162 aa, synthetic construct
MRSSPGNMERIVICLMVIFLGTLVHKSSSQGQDRFMIQMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2839 - protein, 162 aa, synthetic construct
MRSSPGNMERIVICLMVIFLGTLVHKSSSQGQDRHMWRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2840 - protein, 162 aa, synthetic construct
MRSSPGNMERIVICLMVIFLGTLVHKSSSQGQDRHMIRMRQLIDIVDQLKNYVNDLVPEFLPAPEDVETRCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2841 - protein, 162 aa, synthetic construct
MRSSPGNMERIVICLMVIFLGTLVHKSSSQGQDRHMIRMRQLIDIVDQLKNYVNDLVPEFLPAPEDVETWCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2842 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFRKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2843 - protein, 162 aa, synthetic construct
MRSSPGNMERIVICLMVIFLGTLVHKSSSQGQDRIMIRMRQLIDIVDQLKNQVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2844 - protein, 162 aa, synthetic construct
MRSSPGNMERIVICLMVIFLGTLVHKSSSQGQDRHMIKMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 2845 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERISNESIKKLKRKPPSTNAGRRQKHRLTCPSCDSYEKKPPKEFLERFKSLLQKMIHQHLSSRTHGSEDS

SEQ ID NO: 2846 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFLKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2847 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKLANTGNNERIINVSIKKLKRKPPSDNPGRRQKHRLTCPSCDSYEKKPPKEFLERFKSLLQKMIHQHLSSRTHGSEDS

SEQ ID NO: 2848 - protein, 162 aa, synthetic construct
MRSSPGNMERIVICLMVIFLGTLVHKSSSQGQDRHMIRMRQLIMIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2849 - protein, 162 aa, synthetic construct
MRSSPGNMERIVICLMVIFLGTLVHKSSSQGQDRHMIRMRQLIPIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2850 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKKKVPSTNAGQDQKHRLTCPSCDSYEKKPPKEFLERFKSLLQKMIHQHLSSRTHGSEDS

SEQ ID NO: 2851 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIYNVSIKKLKRKPPSTNAGQDQKHRLTCPSCDSYEKKPPKEFLERFKSLLQKMIHQHLSSRTHGSEDS

SEQ ID NO: 2852 - protein, 162 aa, synthetic construct
MRSSPGNMERIVICLMVIFLGTLVHKSSSQGQDWHMIRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2853 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKMKVPSTNAGQDQKHRLTCPSCDSYEKKPPKEFLERFKSLLQKMIHQHLSSRTHGSEDS

SEQ ID NO: 2854 - protein, 162 aa, synthetic construct
MRSSPGNMERIVICLMVIFLGTLVHKSSSQGQDRHMIRMRQLIDQVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2855 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKELKRKPPSTNAGRRQKHRLTCPSCDSYEKKPPKEFLERFKSLLQKMIHQHLSSRTHGSEDS

SEQ ID NO: 2856 - protein, 162 aa, synthetic construct
MRSSPGNMERIVICLMVIFLGTLVHKSSSQGQDRFMIRMRQLIDWVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2857 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSRKKLKRKPPSTNAGQDQKHRLTCPSCDSYEKKPPKEFLERFKSLLQKMIHQHLSSRTHGSEDS

SEQ ID NO: 2858 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESGKKLKRKPPSDNAGRRQKHRLTCPSCDSYEKKPPKEFLERFKSLLQKMIHQHLSSRTHGSEDS

SEQ ID NO: 2859 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERITNVSIKKLKRKPPSTNAGRRQKHRLTCPSCDSYEKKPPKEFLERFKSLLQKMIHQHLSSRTHGSEDS

SEQ ID NO: 2860 - protein, 162 aa, synthetic construct
MRSSPGNMERIVICLMVIFLGTLVHKSSSQGQDRIMIRMRQLINIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2861 - protein, 162 aa, synthetic construct
MRSSPGNMERIVICLMVIFLGTLVHKSSSQGQDRHMIWMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 2862 - protein, 162 aa, synthetic construct
MRSSPGNMERIVICLMVIFLGTLVHKSSSQGQDRHMIRMRQLIHIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2863 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINKSIKKLKRKPPSTNAGRRQKHRLTCPSCDSYEKKPPKEFLERFKSLLQKMIHQHLSSRTHGSEDS

SEQ ID NO: 2864 - protein, 162 aa, synthetic construct
MRSSPGNMERIVICLMVIFLGTLVHKSSSQGQDRHMIRMRQLIDIVDQLKNYVNDVVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2865 - protein, 162 aa, synthetic construct
MRSSPGNMERIVICLMVIFLGTLVHKSSSQGQDRHMISMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2866 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPNSTNAGRRQKHRLTCPSCDSYEKKPPKEFLERFKSLLQKMIHQHLSSRTHGSEDS

SEQ ID NO: 2867 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPRSDNPGRRQKHRLTCPSCDSYEKKPPKEFLERFKSLLQKMIHQHLSSRTHGSEDS

SEQ ID NO: 2868 - protein, 162 aa, synthetic construct
MRSSPGNMERIVICLMVIFLGTLVHKSSSQGQDRHMINMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2869 - protein, 162 aa, synthetic construct
MRSSPGNMERIVICLMVIFLGTLVHKSSSQGQDRIMIRMRQLISIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2870 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSFKKLKRKPPSTNAGRRQKHRLTCPSCDSYEKKPPKEFLERFKSLLQKMIHQHLSSRTHGSEDS

SEQ ID NO: 2871 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKMKPPSDNPGRRQKHRLTCPSCDSYEKKPPKEFLERFKSLLQKMIHQHLSSRTHGSEDS

SEQ ID NO: 2872 - protein, 162 aa, synthetic construct
MRSSPGNMERIVICLMVIFLGTLVHKSSSQGQDRIMIRMRQLIDIVDRLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2873 - protein, 162 aa, synthetic construct
MRSSPGNMERIVICLMVIFLGTLVHKSSSQGQDRIMIRMRQLIDIVDQLKNSVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2874 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKNKPPSDNAGRRQKHRLTCPSCDSYEKKPPKEFLERFKSLLQKMIHQHLSSRTHGSEDS

SEQ ID NO: 2875 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQFKSANTGNNERIINVSIKKLKRKPPSDNPGRRQKHRLTCPSCDSYEKKPPKEFLERFKSLLQKMIHQHLSSRTHGSEDS

SEQ ID NO: 2876 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKRKKPSTNAGRRQKHRLTCPSCDSYEKKPPKEFLERFKSLLQKMIHQHLSSRTHGSEDS

SEQ ID NO: 2877 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKWKRKPPSTNAGQDQKHRLTCPSCDSYEKKPPKEFLERFKSLLQKMIHQHLSSRTHGSEDS

SEQ ID NO: 2878 - protein, 162 aa, synthetic construct
MRSSPGNMERIVICLMVIFLGTLVHKSSSQGQDRIMIRMRQLIDIVDQLKNTVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2879 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQYAQLKSANTGNNERIINVSIKKLKRKPPSTNAGRRQKHRLTCPSCDSYEKKPPKEFLERFKSLLQKMIHQHLSSRTHGSEDS

SEQ ID NO: 2880 - protein, 162 aa, synthetic construct
MRSSPGNMERIVICLMVIFLGTLVHKSSSQGQDRIMIRMRQLIHIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2881 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKMKPPSTNAGQDQKHRLTCPSCDSYEKKPPKEFLERFKSLLQKMIHQHLSSRTHGSEDS

SEQ ID NO: 2882 - protein, 162 aa, synthetic construct
MRSSPGNMERIVICLMVIFLGTLVHKSSSQGQDRHMIRMRQLIDIVDQLKNYVNDLVPEFLPAPEDVETGCWWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2883 - protein, 162 aa, synthetic construct
MRSSPGNMERIVICLMVIFLGTLVHKSSSQGQDRFMIRMRQRIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2884 - protein, 162 aa, synthetic construct
MRSSPGNMERIVICLMVIFLGTLVHKSSSQGQDRHMILMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2885 - protein, 162 aa, synthetic construct
MRSSPGNMERIVICLMVIFLGTLVHKSSSQGQDRIMIMMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2886 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSYKKLKRKPPSTNAGQDQKHRLTCPSCDSYEKKPPKEFLERFKSLLQKMIHQHLSSRTHGSEDS

SEQ ID NO: 2887 - protein, 162 aa, synthetic construct
MRSSPGNMERIVICLMVIFLGTLVHKSSSQGQDRHMPRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2888 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSQKKLKRKPPSTNAGQDQKHRLTCPSCDSYEKKPPKEFLERFKSLLQKMIHQHLSSRTHGSEDS

SEQ ID NO: 2889 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 2890 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPPSDNPGRRQKKRLTCPSCDSYEKKPPKEFLERFKSLLQKMIHQHLSSRTHGSEDS

SEQ ID NO: 2891 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKRPSDNPGRRQKHRLTCPSCDSYEKKPPKEFLERFKSLLQKMIHQHLSSRTHGSEDS

SEQ ID NO: 2892 - protein, 162 aa, synthetic construct
MRSSPGNMERIVICLMVIFLGTLVHKSSSQGQDRIMHRMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2893 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIHNESIKKLKRKPPSDNAGRRQKHRLTCPSCDSYEKKPPKEFLERFKSLLQKMIHQHLSSRTHGSEDS

SEQ ID NO: 2894 - protein, 162 aa, synthetic construct
MRSSPGNMERIVICLMVIFLGTLVHKSSSQGQDRHMIQMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 2895 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAKSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2896 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIIKVSIKKLKRKPPSDNPGRRQKHRLTCPSCDSYEKKPPKEFLERFKSLLQKMIHQHLSSRTHGSEDS

SEQ ID NO: 2897 - protein, 162 aa, synthetic construct
MRSSPGNMERIVICLMVIFLGTLVHKSSSQGQDRIMNRMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2898 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFRDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2899 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERRINVSIKKLKRKPPSTNAGRRQKHRLTCPSCDSYEKKPPKEFLERFKSLLQKMIHQHLSSRTHGSEDS

SEQ ID NO: 2900 - protein, 162 aa, synthetic construct
MRSSPGNMERIVICLMVIFLGTLVHKSSSQGQDRIMGRMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2901 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINKSIKKLKRKVPSTNAGRRQKHRLTCPSCDSYEKKPPKEFLERFKSLLQKMIHQHLSSRTHGSEDS

SEQ ID NO: 2902 - protein, 162 aa, synthetic construct
MRSSPGNMERIVICLMVIFLGTLVHKSSSQGQDRHMIRMRQLIFIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2903 - protein, 162 aa, synthetic construct
MRSSPGNMERIVICLMVIFLGTLVHKSSSQGQDRHMIRMRQLIYIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2904 - protein, 162 aa, synthetic construct
MRSSPGNMERIVICLMVIFLGTLVHKSSSQGQDRHMDRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2905 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINKSIKKLKRKPPSDNPGRRQKHRLTCPSCDSYEKKPPKEFLERFKSLLQKMIHQHLSSRTHGSEDS

SEQ ID NO: 2906 - protein, 162 aa, synthetic construct
MRSSPGNMERIVICLMVIFLGTLVHKSSSQGQDRFMIRMRPLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2907 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQHAQLKSANTGNNERIINVSIKKLKRKPPSTNAGRRQKHRLTCPSCDSYEKKPPKEFLERFKSLLQKMIHQHLSSRTHGSEDS

SEQ ID NO: 2908 - protein, 162 aa, synthetic construct
MRSSPGNMERIVICLMVIFLGTLVHKSSSQGQDRHMIMMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2909 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKFKPPSDNPGRRQKHRLTCPSCDSYEKKPPKEFLERFKSLLQKMIHQHLSSRTHGSEDS

SEQ ID NO: 2910 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKNKPPSTNAGRRQKHRLTCPSCDSYEKKPPKEFLERFKSLLQKMIHQHLSSRTHGSEDS

SEQ ID NO: 2911 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNRRIINVSIKKLKRKPPSDNPGRRQKHRLTCPSCDSYEKKPPKEFLERFKSLLQKMIHQHLSSRTHGSEDS

SEQ ID NO: 2912 - protein, 162 aa, synthetic construct
MRSSPGNMERIVICLMVIFLGTLVHKSSSQGQDRHMIRMRQLIDWVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2913 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKRANTGNNERIINVSIKKLKRKPPSDNPGRRQKHRLTCPSCDSYEKKPPKEFLERFKSLLQKMIHQHLSSRTHGSEDS

SEQ ID NO: 2914 - protein, 162 aa, synthetic construct
MRSSPGNMERIVICLMVIFLGTLVHKSSSQGQDRHMIVMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 2915 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFYDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2916 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNFRIINVSIKKLKRKPPSDNPGRRQKHRLTCPSCDSYEKKPPKEFLERFKSLLQKMIHQHLSSRTHGSEDS

SEQ ID NO: 2917 - protein, 162 aa, synthetic construct
MRSSPGNMERIVICLMVIFLGTLVHKSSSQGQDRIMRRMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2918 - protein, 162 aa, synthetic construct
MRSSPGNMERIVICLMVIFLGTLVHKSSSQGQDRIMIRMRQLIDQVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2919 - protein, 162 aa, synthetic construct
MRSSPGNMERIVICLMVIFLGTLVHKSSSQGQDRHMGRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2920 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSFKKLKRKPPSDNPGRRQKHRLTCPSCDSYEKKPPKEFLERFKSLLQKMIHQHLSSRTHGSEDS

SEQ ID NO: 2921 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFDDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2922 - protein, 162 aa, synthetic construct
MRSSPGNMERIVICLMVIFLGTLVHKSSSQGQDRHMIRMRWLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2923 - protein, 162 aa, synthetic construct
MRSSPGNMERIVICLMVIFLGTLVHKSSSQGQDRHMRRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2924 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKIKPPSDNAGRRQKHRLTCPSCDSYEKKPPKEFLERFKSLLQKMIHQHLSSRTHGSEDS

SEQ ID NO: 2925 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKWKVPSTNAGQDQKHRLTCPSCDSYEKKPPKEFLERFKSLLQKMIHQHLSSRTHGSEDS

SEQ ID NO: 2926 - protein, 162 aa, synthetic construct
MRSSPGNMERIVICLMVIFLGTLVHKSSSQGQDRIMIKMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2927 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFWKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2928 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSSKKLKRKPPSTNAGRRQKHRLTCPSCDSYEKKPPKEFLERFKSLLQKMIHQHLSSRTHGSEDS

SEQ ID NO: 2929 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKRKPKSDNPGRRQKHRLTCPSCDSYEKKPPKEFLERFKSLLQKMIHQHLSSRTHGSEDS

SEQ ID NO: 2930 - protein, 162 aa, synthetic construct
MRSSPGNMERIVICLMVIFLGTLVHKSSSQGQDRIMIRMRQLIYIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2931 - protein, 162 aa, synthetic construct
MRSSPGNMERIVICLMVIFLGTLVHKSSSQGQDRIMIRMRQLIFIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2932 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAKSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2933 - protein, 162 aa, synthetic construct
MRSSPGNMERIVICLMVIFLGTLVHKSSSQGQDRHMIWMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2934 - protein, 162 aa, synthetic construct
MRSSPGNMERIVICLMVIFLGTLVHKSSSQGQDRHMISMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 2935 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCIQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2936 - protein, 162 aa, synthetic construct
MRSSPGNMERIVICLMVIFLGTLVHKSSSQGQDRHMIRGRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2937 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSEKKLKRKPPSTNAGQDQKHRLTCPSCDSYEKKPPKEFLERFKSLLQKMIHQHLSSRTHGSEDS

SEQ ID NO: 2938 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKQKVPSTNAGQDQKHRLTCPSCDSYEKKPPKEFLERFKSLLQKMIHQHLSSRTHGSEDS

SEQ ID NO: 2939 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKAKPPSDNPGRRQKHRLTCPSCDSYEKKPPKEFLERFKSLLQKMIHQHLSSRTHGSEDS

SEQ ID NO: 2940 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKNKPPSDNPGRRQKHRLTCPSCDSYEKKPPKEFLERFKSLLQKMIHQHLSSRTHGSEDS

SEQ ID NO: 2941 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKQKVPSTNAGRRQKHRLTCPSCDSYEKKPPKEFLERFKSLLQKMIHQHLSSRTHGSEDS

SEQ ID NO: 2942 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKAKPPSDNAGRRQKHRLTCPSCDSYEKKPPKEFLERFKSLLQKMIHQHLSSRTHGSEDS

SEQ ID NO: 2943 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKSKVPSTNAGRRQKHRLTCPSCDSYEKKPPKEFLERFKSLLQKMIHQHLSSRTHGSEDS

SEQ ID NO: 2944 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNRRIINVSIKKLKRKPPSTNAGRRQKHRLTCPSCDSYEKKPPKEFLERFKSLLQKMIHQHLSSRTHGSEDS

SEQ ID NO: 2945 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVKIKKLKRKPPSDNPGRRQKHRLTCPSCDSYEKKPPKEFLERFKSLLQKMIHQHLSSRTHGSEDS

SEQ ID NO: 2946 - protein, 162 aa, synthetic construct
MRSSPGNMERIVICLMVIFLGTLVHKSSSQGQDRHMKRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2947 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKSKVPSTNAGQDQKHRLTCPSCDSYEKKPPKEFLERFKSLLQKMIHQHLSSRTHGSEDS

SEQ ID NO: 2948 - protein, 162 aa, synthetic construct
MRSSPGNMERIVICLMVIFLGTLVHKSSSQGQDRIMIRMRQLIDIVDQLKNYVNDTVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2949 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIGNVSIKKLKRKPPSTNAGQDQKHRLTCPSCDSYEKKPPKEFLERFKSLLQKMIHQHLSSRTHGSEDS

SEQ ID NO: 2950 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKIKVPSTNAGRRQKHRLTCPSCDSYEKKPPKEFLERFKSLLQKMIHQHLSSRTHGSEDS

SEQ ID NO: 2951 - protein, 162 aa, synthetic construct
MRSSPGNMERIVICLMVIFLGTLVHKSSSQGQDRHMITMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2952 - protein, 162 aa, synthetic construct
MRSSPGNMERIVICLMVIFLGTLVHKSSSQGQDRHMIVMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2953 - protein, 162 aa, synthetic construct
MRSSPGNMERIVICLMVIFLGTLVHKSSSQGQDRIMIRMRQLIDIVDQLKNRVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2954 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINKSIKKLKRKPPSTNAGRRQKHRLTCPSCDSYEKKPPKEFLERFKSLLQKMIHQHLSSRTHGSEDS

SEQ ID NO: 2955 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAFLKSANTGNNERIINVSIKKLKRKPPSDNPGRRQKHRLTCPSCDSYEKKPPKEFLERFKSLLQKMIHQHLSSRTHGSEDS

SEQ ID NO: 2956 - protein, 162 aa, synthetic construct
MRSSPGNMERIVICLMVIFLGTLVHKSSSQGQDRHMNRMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2957 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFKDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2958 - protein, 162 aa, synthetic construct
MRSSPGNMERIVICLMVIFLGTLVHKSSSQGQDRIMIQMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2959 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKQKPPSDNPGRRQKHRLTCPSCDSYEKKPPKEFLERFKSLLQKMIHQHLSSRTHGSEDS

SEQ ID NO: 2960 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAFLKSANTGNNERIINVSIKKLKRKPPSTNAGRRQKHRLTCPSCDSYEKKPPKEFLERFKSLLQKMIHQHLSSRTHGSEDS

SEQ ID NO: 2961 - protein, 162 aa, synthetic construct
MRSSPGNMERIVICLMVIFLGTLVHKSSSQGQDRIMIRMRQLIRIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2962 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIDNVSIKKLKRKPPSTNAGQDQKHRLTCPSCDSYEKKPPKEFLERFKSLLQKMIHQHLSSRTHGSEDS

SEQ ID NO: 2963 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIPNVSIKKLKRKPPSTNAGQDQKHRLTCPSCDSYEKKPPKEFLERFKSLLQKMIHQHLSSRTHGSEDS

SEQ ID NO: 2964 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSGKKLKRKPPSTNAGQDQKHRLTCPSCDSYEKKPPKEFLERFKSLLQKMIHQHLSSRTHGSEDS

SEQ ID NO: 2965 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDALLKSANTGNNERIINVSIKKLKRKPPSTNAGRRQKHRLTCPSCDSYEKKPPKEFLERFKSLLQKMIHQHLSSRTHGSEDS

SEQ ID NO: 2966 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKYKRKPPSTNAGQDQKHRLTCPSCDSYEKKPPKEFLERFKSLLQKMIHQHLSSRTHGSEDS

SEQ ID NO: 2967 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKYKPPSTNAGQDQKHRLTCPSCDSYEKKPPKEFLERFKSLLQKMIHQHLSSRTHGSEDS

SEQ ID NO: 2968 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKNKVPSTNAGQDQKHRLTCPSCDSYEKKPPKEFLERFKSLLQKMIHQHLSSRTHGSEDS

SEQ ID NO: 2969 - protein, 162 aa, synthetic construct
MRSSPGNMERIVICLMVIFLGTLVHKSSSQGQDRHMERMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2970 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERITNVSIKKLKRKPPSDNPGRRQKHRLTCPSCDSYEKKPPKEFLERFKSLLQKMIHQHLSSRTHGSEDS

SEQ ID NO: 2971 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKFKRKPPSTNAGRRQKHRLTCPSCDSYEKKPPKEFLERFKSLLQKMIHQHLSSRTHGSEDS

SEQ ID NO: 2972 - protein, 162 aa, synthetic construct
MRSSPGNMERIVICLMVIFLGTLVHKSSSQGQDRFMITMRQLIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2973 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKVKPPSDNPGRRQKHRLTCPSCDSYEKKPPKEFLERFKSLLQKMIHQHLSSRTHGSEDS

SEQ ID NO: 2974 - protein, 162 aa, synthetic construct
MRSSPGNMERIVICLMVIFLGTLVHKSSSQGQDRIMIAMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2975 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKIKPPSDNPGRRQKHRLTCPSCDSYEKKPPKEFLERFKSLLQKMIHQHLSSRTHGSEDS

SEQ ID NO: 2976 - protein, 162 aa, synthetic construct
MRSSPGNMERIVICLMVIFLGTLVHKSSSQGQDRHMIIMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 2977 - protein, 162 aa, synthetic construct
MRSSPGNMERIVICLMVIFLGTLVHKSSSQGQDRFMIRMRQLIDKVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 2978 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKKKPPSTNAGRRQKHRLTCPSCDSYEKKPPKEFLERFKSLLQKMIHQHLSSRTHGSEDS

SEQ ID NO: 2979 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKQKPPSDNAGRRQKHRLTCPSCDSYEKKPPKEFLERFKSLLQKMIHQHLSSRTHGSEDS

SEQ ID NO: 2980 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVPIKKLKRKPPSTNAGRRQKHRLTCPSCDSYEKKPPKEFLERFKSLLQKMIHQHLSSRTHGSEDS

SEQ ID NO: 2981 - protein, 162 aa, synthetic construct
MRSSPGNMERIVICLMVIFLGTLVHKSSSQGQDRFMINMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2982 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERISNVSIKKLKRKPPSTNAGQDQKHRLTCPSCDSYEKKPPKEFLERFKSLLQKMIHQHLSSRTHGSEDS

SEQ ID NO: 2983 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKQKPPSTNAGQDQKHRLTCPSCDSYEKKPPKEFLERFKSLLQKMIHQHLSSRTHGSEDS

SEQ ID NO: 2984 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKTKPPSDNPGRRQKHRLTCPSCDSYEKKPPKEFLERFKSLLQKMIHQHLSSRTHGSEDS

SEQ ID NO: 2985 - protein, 162 aa, synthetic construct
MRSSPGNMERIVICLMVIFLGTLVHKSSSQGQDRHMIRMRPLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2986 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKFKPPSTNAGQDQKHRLTCPSCDSYEKKPPKEFLERFKSLLQKMIHQHLSSRTHGSEDS

SEQ ID NO: 2987 - protein, 162 aa, synthetic construct
MRSSPGNMERIVICLMVIFLGTLVHKSSSQGQDRHMIRMRKLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 2988 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKWKPPSTNAGRRQKHRLTCPSCDSYEKKPPKEFLERFKSLLQKMIHQHLSSRTHGSEDS

SEQ ID NO: 2989 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKSKPPSDNAGRRQKHRLTCPSCDSYEKKPPKEFLERFKSLLQKMIHQHLSSRTHGSEDS

SEQ ID NO: 2990 - protein, 162 aa, synthetic construct
MRSSPGNMERIVICLMVIFLGTLVHKSSSQGQDRIMIRMRQLIKIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 2991 - protein, 162 aa, synthetic construct
MRSSPGNMERIVICLMVIFLGTLVHKSSSQGQDEHMIRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2992 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVRIKKLKRKPPSTNAGRRQKHRLTCPSCDSYEKKPPKEFLERFKSLLQKMIHQHLSSRTHGSEDS

SEQ ID NO: 2993 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAWLKSANTGNNERIINVSIKKLKRKPPSDNPGRRQKHRLTCPSCDSYEKKPPKEFLERFKSLLQKMIHQHLSSRTHGSEDS

SEQ ID NO: 2994 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKTKPPSDNAGRRQKHRLTCPSCDSYEKKPPKEFLERFKSLLQKMIHQHLSSRTHGSEDS

SEQ ID NO: 2995 - protein, 162 aa, synthetic construct
MRSSPGNMERIVICLMVIFLGTLVHKSSSQGQDRFMIIMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 2996 - protein, 162 aa, synthetic construct
MRSSPGNMERIVICLMVIFLGTLVHKSSSQGQDRHMITMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2997 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKIKVPSTNAGQDQKHRLTCPSCDSYEKKPPKEFLERFKSLLQKMIHQHLSSRTHGSEDS

SEQ ID NO: 2998 - protein, 162 aa, synthetic construct
MRSSPGNMERIVICLMVIFLGTLVHKSSSQGQDRHMIIMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 2999 - protein, 162 aa, synthetic construct
MRSSPGNMERIVICLMVIFLGTLVHKSSSQGQDRIMITMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 3000 - protein, 162 aa, synthetic construct
MRSSPGNMERIVICLMVIFLGTLVHKSSSQGQDRFMIDMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 3001 - protein, 162 aa, synthetic construct
MRSSPGNMERIVICLMVIFLGTLVHKSSSQGQDRHMIRMRKLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 3002 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAKSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 3003 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKAKPPSTNAGRRQKHRLTCPSCDSYEKKPPKEFLERFKSLLQKMIHQHLSSRTHGSEDS

SEQ ID NO: 3004 - protein, 162 aa, synthetic construct
MRSSPGNMERIVICLMVIFLGTLVHKSSSQGQDRHMILMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 3005 - protein, 162 aa, synthetic construct
MRSSPGNMERIVICLMVIFLGTLVHKSSSQGQDRHMINMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 3006 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKWKPPSDNAGRRQKHRLTCPSCDSYEKKPPKEFLERFKSLLQKMIHQHLSSRTHGSEDS

SEQ ID NO: 3007 - protein, 162 aa, synthetic construct
MRSSPGNMERIVICLMVIFLGTLVHKSSSQGQDRHMIAMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 3008 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKLKPPSTNAGRRQKHRLTCPSCDSYEKKPPKEFLERFKSLLQKMIHQHLSSRTHGSEDS

SEQ ID NO: 3009 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKRKPRSTNAGRRQKHRLTCPSCDSYEKKPPKEFLERFKSLLQKMIHQHLSSRTHGSEDS

SEQ ID NO: 3010 - protein, 162 aa, synthetic construct
MRSSPGNMERIVICLMVIFLGTLVHKSSSQGQDRHMIVMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 3011 - protein, 162 aa, synthetic construct
MRSSPGNMERIVICLMVIFLGTLVHKSSSQGQDRHMINMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 3012 - protein, 162 aa, synthetic construct
MRSSPGNMERIVICLMVIFLGTLVHKSSSQGQDRHMIIMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 3013 - protein, 162 aa, synthetic construct
MRSSPGNMERIVICLMVIFLGTLVHKSSSQGQDRHMIDMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 3014 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKEKPPSTNAGRRQKHRLTCPSCDSYEKKPPKEFLERFKSLLQKMIHQHLSSRTHGSEDS

SEQ ID NO: 3015 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKYKPPSTNAGRRQKHRLTCPSCDSYEKKPPKEFLERFKSLLQKMIHQHLSSRTHGSEDS

SEQ ID NO: 3016 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKVKRKPPSTNAGRRQKHRLTCPSCDSYEKKPPKEFLERFKSLLQKMIHQHLSSRTHGSEDS

SEQ ID NO: 3017 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKGKVPSTNAGRRQKHRLTCPSCDSYEKKPPKEFLERFKSLLQKMIHQHLSSRTHGSEDS

SEQ ID NO: 3018 - protein, 162 aa, synthetic construct
MRSSPGNMERIVICLMVIFLGTLVHKSSSQGQDRHMILMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 3019 - protein, 162 aa, synthetic construct
MRSSPGNMERIVICLMVIFLGTLVHKSSSQGQDRHMIDMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 3020 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESHKKLKRKPPSDNAGRRQKHRLTCPSCDSYEKKPPKEFLERFKSLLQKMIHQHLSSRTHGSEDS

SEQ ID NO: 3021 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKVKRKPPSDNPGRRQKHRLTCPSCDSYEKKPPKEFLERFKSLLQKMIHQHLSSRTHGSEDS

SEQ ID NO: 3022 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAWLKSANTGNNERIINVSIKKLKRKPPSTNAGRRQKHRLTCPSCDSYEKKPPKEFLERFKSLLQKMIHQHLSSRTHGSEDS

SEQ ID NO: 3023 - protein, 162 aa, synthetic construct
MRSSPGNMERIVICLMVIFLGTLVHKSSSQGQDDHMIRMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 3024 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKNKPPSTNAGQDQKHRLTCPSCDSYEKKPPKEFLERFKSLLQKMIHQHLSSRTHGSEDS

SEQ ID NO: 3025 - protein, 162 aa, synthetic construct
MRSSPGNMERIVICLMVIFLGTLVHKSSSQGQDRHMINMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 3026 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKMKPPSTNAGRRQKHRLTCPSCDSYEKKPPKEFLERFKSLLQKMIHQHLSSRTHGSEDS

SEQ ID NO: 3027 - protein, 162 aa, synthetic construct
MRSSPGNMERIVICLMVIFLGTLVHKSSSQGQDRIMIRMRQLIDWVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 3028 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIENVSIKKLKRKPPSTNAGRRQKHRLTCPSCDSYEKKPPKEFLERFKSLLQKMIHQHLSSRTHGSEDS

SEQ ID NO: 3029 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSDKKLKRKPPSTNAGQDQKHRLTCPSCDSYEKKPPKEFLERFKSLLQKMIHQHLSSRTHGSEDS

SEQ ID NO: 3030 - protein, 162 aa, synthetic construct
MRSSPGNMERIVICLMVIFLGTLVHKSSSQGQDRHMIPMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 3031 - protein, 162 aa, synthetic construct
MRSSPGNMERIVICLMVIFLGTLVHKSSSQGQDRHMIDMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 3032 - protein, 162 aa, synthetic construct
MRSSPGNMERIVICLMVIFLGTLVHKSSSQGQDRIMIDMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 3033 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKLKPPSTNAGRRQKHRLTCPSCDSYEKKPPKEFLERFKSLLQKMIHQHLSSRTHGSEDS

SEQ ID NO: 3034 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERINNVSIKKLKRKPPSTNAGRRQKHRLTCPSCDSYEKKPPKEFLERFKSLLQKMIHQHLSSRTHGSEDS

SEQ ID NO: 3035 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKEKPPSTNAGRRQKHRLTCPSCDSYEKKPPKEFLERFKSLLQKMIHQHLSSRTHGSEDS

SEQ ID NO: 3036 - protein, 162 aa, synthetic construct
MRSSPGNMERIVICLMVIFLGTLVHKSSSQGQDRIMIRMRRLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 3037 - protein, 162 aa, synthetic construct
MRSSPGNMERIVICLMVIFLGTLVHKSSSQGQDRHMIEMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 3038 - protein, 162 aa, synthetic construct
MRSSPGNMERIVICLMVIFLGTLVHKSSSQGQDRFMIDMRQLIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 3039 - protein, 162 aa, synthetic construct
MRSSPGNMERIVICLMVIFLGTLVHKSSSQGQDRHMIEMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 3040 - protein, 162 aa, synthetic construct
MRSSPGNMERIVICLMVIFLGTLVHKSSSQGQDRIMISMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 3041 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKEKPPSDNPGRRQKHRLTCPSCDSYEKKPPKEFLERFKSLLQKMIHQHLSSRTHGSEDS

SEQ ID NO: 3042 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSHKKLKRKPPSTNAGQDQKHRLTCPSCDSYEKKPPKEFLERFKSLLQKMIHQHLSSRTHGSEDS

SEQ ID NO: 3043 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIRNVSIKKLKRKPPSTNAGQDQKHRLTCPSCDSYEKKPPKEFLERFKSLLQKMIHQHLSSRTHGSEDS

SEQ ID NO: 3044 - protein, 162 aa, synthetic construct
MRSSPGNMERIVICLMVIFLGTLVHKSSSQGQDRHMIRMRQLIDKVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 3045 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKAKPPSTNAGRRQKHRLTCPSCDSYEKKPPKEFLERFKSLLQKMIHQHLSSRTHGSEDS

SEQ ID NO: 3046 - protein, 162 aa, synthetic construct
MRSSPGNMERIVICLMVIFLGTLVHKSSSQGQDRIMILMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 3047 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKTKPPSTNAGRRQKHRLTCPSCDSYEKKPPKEFLERFKSLLQKMIHQHLSSRTHGSEDS

SEQ ID NO: 3048 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKHKPPSDNPGRRQKHRLTCPSCDSYEKKPPKEFLERFKSLLQKMIHQHLSSRTHGSEDS

SEQ ID NO: 3049 - protein, 162 aa, synthetic construct
MRSSPGNMERIVICLMVIFLGTLVHKSSSQGQDRHMISMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 3050 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKIKPPSTNAGRRQKHRLTCPSCDSYEKKPPKEFLERFKSLLQKMIHQHLSSRTHGSEDS

SEQ ID NO: 3051 - protein, 162 aa, synthetic construct
MRSSPGNMERIVICLMVIFLGTLVHKSSSQGQDRHMISMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 3052 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKSKPPSTNAGRRQKHRLTCPSCDSYEKKPPKEFLERFKSLLQKMIHQHLSSRTHGSEDS

SEQ ID NO: 3053 - protein, 162 aa, synthetic construct
MRSSPGNMERIVICLMVIFLGTLVHKSSSQGQDRHMILMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 3054 - protein, 162 aa, synthetic construct
MRSSPGNMERIVICLMVIFLGTLVHKSSSQGQDRFMIVMRQLIDIVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 3055 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKVKPPSTNAGRRQKHRLTCPSCDSYEKKPPKEFLERFKSLLQKMIHQHLSSRTHGSEDS

SEQ ID NO: 3056 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIANVSIKKLKRKPPSDNPGRRQKHRLTCPSCDSYEKKPPKEFLERFKSLLQKMIHQHLSSRTHGSEDS

SEQ ID NO: 3057 - protein, 162 aa, synthetic construct
MRSSPGNMERIVICLMVIFLGTLVHKSSSQGQDRHMIPMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 3058 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKYKPPSTNAGRRQKHRLTCPSCDSYEKKPPKEFLERFKSLLQKMIHQHLSSRTHGSEDS

SEQ ID NO: 3059 - protein, 162 aa, synthetic construct
MRSSPGNMERIVICLMVIFLGTLVHKSSSQGQDRFMIRMRQLIDKVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 3060 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKVKVPSTNAGQDQKHRLTCPSCDSYEKKPPKEFLERFKSLLQKMIHQHLSSRTHGSEDS

SEQ ID NO: 3061 - protein, 162 aa, synthetic construct
MRSSPGNMERIVICLMVIFLGTLVHKSSSQGQDRHMIRMRQLIDIVDQLKNYVNDLVPEFLPAPEDVETGCEWSYFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 3062 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKEKRKPPSTNAGQDQKHRLTCPSCDSYEKKPPKEFLERFKSLLQKMIHQHLSSRTHGSEDS

SEQ ID NO: 3063 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKEKPPSTNAGQDQKHRLTCPSCDSYEKKPPKEFLERFKSLLQKMIHQHLSSRTHGSEDS

SEQ ID NO: 3064 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKQKRKPPSTNAGQDQKHRLTCPSCDSYEKKPPKEFLERFKSLLQKMIHQHLSSRTHGSEDS

SEQ ID NO: 3065 - protein, 162 aa, synthetic construct
MRSSPGNMERIVICLMVIFLGTLVHKSSSQGQDRHMIRMRKLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 3066 - protein, 162 aa, synthetic construct
MRSSPGNMERIVICLMVIFLGTLVHKSSSQGQDRIMIRMRQLIDRVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 3067 - protein, 162 aa, synthetic construct
MRSSPGNMERIVICLMVIFLGTLVHKSSSQGQDRFMIRMRQLIDRVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 3068 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKKKPPSTNAGRRQKHRLTCPSCDSYEKKPPKEFLERFKSLLQKMIHQHLSSRTHGSEDS

SEQ ID NO: 3069 - protein, 162 aa, synthetic construct
MRSSPGNMERIVICLMVIFLGTLVHKSSSQGQDRHMIRMRRLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 3070 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKGKVPSTNAGQDQKHRLTCPSCDSYEKKPPKEFLERFKSLLQKMIHQHLSSRTHGSEDS

SEQ ID NO: 3071 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKDKPPSTNAGRRQKHRLTCPSCDSYEKKPPKEFLERFKSLLQKMIHQHLSSRTHGSEDS

SEQ ID NO: 3072 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKWKPPSTNAGRRQKHRLTCPSCDSYEKKPPKEFLERFKSLLQKMIHQHLSSRTHGSEDS

SEQ ID NO: 3073 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIQNVSIKKLKRKPPSTNAGRRQKHRLTCPSCDSYEKKPPKEFLERFKSLLQKMIHQHLSSRTHGSEDS

SEQ ID NO: 3074 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKHKRKPPSTNAGQDQKHRLTCPSCDSYEKKPPKEFLERFKSLLQKMIHQHLSSRTHGSEDS

SEQ ID NO: 3075 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKGKPPSTNAGRRQKHRLTCPSCDSYEKKPPKEFLERFKSLLQKMIHQHLSSRTHGSEDS

SEQ ID NO: 3076 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKDKRKPPSTNAGQDQKHRLTCPSCDSYEKKPPKEFLERFKSLLQKMIHQHLSSRTHGSEDS

SEQ ID NO: 3077 - protein, 162 aa, synthetic construct
MRSSPGNMERIVICLMVIFLGTLVHKSSSQGQDRHMIQMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 3078 - protein, 162 aa, synthetic construct
MRSSPGNMERIVICLMVIFLGTLVHKSSSQGQDRHMIPMRQLIDIVDQLKNYVNDLVPEFLPAPEDVETNCEWSAFSCFQDAQLKSANTGNNERIINESIKKLKRKVPSTNAGRRQKHRLTCPSCDSYEKKPPKEFLERFKSLLQKMIHQHLSSRTHGSEDS

SEQ ID NO: 3079 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKEKRKPPSTNAGRRQKHRLTCPSCDSYEKKPPKEFLERFKSLLQKMIHQHLSSRTHGSEDS

SEQ ID NO: 3080 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKIKPPSTNAGRRQKHRLTCPSCDSYEKKPPKEFLERFKSLLQKMIHQHLSSRTHGSEDS

SEQ ID NO: 3081 - protein, 162 aa, synthetic construct
MRSSPGNMERIVICLMVIFLGTLVHKSSSQGQDRHMINMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 3082 - protein, 162 aa, synthetic construct
MRSSPGNMERIVICLMVIFLGTLVHKSSSQGQDRIMIGMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 3083 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKDKPPSTNAGRRQKHRLTCPSCDSYEKKPPKEFLERFKSLLQKMIHQHLSSRTHGSEDS

SEQ ID NO: 3084 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKYKRKPPSTNAGRRQKHRLTCPSCDSYEKKPPKEFLERFKSLLQKMIHQHLSSRTHGSEDS

SEQ ID NO: 3085 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKWKPPSTNAGQDQKHRLTCPSCDSYEKKPPKEFLERFKSLLQKMIHQHLSSRTHGSEDS

SEQ ID NO: 3086 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKNKPPSTNAGRRQKHRLTCPSCDSYEKKPPKEFLERFKSLLQKMIHQHLSSRTHGSEDS

SEQ ID NO: 3087 - protein, 162 aa, synthetic construct
MRSSPGNMERIVICLMVIFLGTLVHKSSSQGQDRHMIVMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 3088 - protein, 162 aa, synthetic construct
MRSSPGNMERIVICLMVIFLGTLVHKSSSQGQDRHMIRMRWLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 3089 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDWQLKSANTGNNERIINVSIKKLKRKPPSTNAGQDQKHRLTCPSCDSYEKKPPKEFLERFKSLLQKMIHQHLSSRTHGSEDS

SEQ ID NO: 3090 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKSKRKPPSTNAGRRQKHRLTCPSCDSYEKKPPKEFLERFKSLLQKMIHQHLSSRTHGSEDS

SEQ ID NO: 3091 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKNKRKPPSTNAGQDQKHRLTCPSCDSYEKKPPKEFLERFKSLLQKMIHQHLSSRTHGSEDS

SEQ ID NO: 3092 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKQKPPSTNAGRRQKHRLTCPSCDSYEKKPPKEFLERFKSLLQKMIHQHLSSRTHGSEDS

SEQ ID NO: 3093 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKPKPPSTNAGRRQKHRLTCPSCDSYEKKPPKEFLERFKSLLQKMIHQHLSSRTHGSEDS

SEQ ID NO: 3094 - protein, 162 aa, synthetic construct
MRSSPGNMERIVICLMVIFLGTLVHKSSSQGQDRFMIRMRQLIDIVDQLKNYVNDLVPEFLPAPEDVETNCEWSAFSCFQDAQLKSANTGNNERIINESIKKLKDKPPSDNAGRRQKHRLTCPSCDSYEKKPPKEFLERFKSLLQKMIHQHLSSRTHGSEDS

SEQ ID NO: 3095 - protein, 162 aa, synthetic construct
MRSSPGNMERIVICLMVIFLGTLVHKSSSQGQDRHMILMRQLIDIVDQLKNYVNDLVPEFLPAPEDVETGCEWSAFSCFQDAQLKSANTGNNERIINVSIKKLKRKPPSTNAGRRQKHRLTCPSCDSYEKKPPKEFLERFKSLLQKMIHQHLSSRTHGSEDS

SEQ ID NO: 3096 - protein, 162 aa, synthetic construct
MRSSPGNMERIVICLMVIFLGTLVHKSSSQGQDRHMIPMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 3097 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKWKPPSTNAGRRQKHRLTCPSCDSYEKKPPKEFLERFKSLLQKMIHQHLSSRTHGSEDS

SEQ ID NO: 3098 - protein, 162 aa, synthetic construct
MRSSPGNMERIVICLMVIFLGTLVHKSSSQGQDRHMIMMRQLIDTVDQLKNYVNDLVPEFLPAPEDVETNCEWSAFSCFQDAQLKSANTGNNERIINESIKKLKRKPPSTNAGRRQKHRLTCPSCDSYEKKPPKEFLERFKSLLQKMIHQHLSSRTHGSEDS

SEQ ID NO: 3099 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKDKPPSDNPGRRQKHRLTCPSCDSYEKKPPKEFLERFKSLLQKMIHQHLSSRTHGSEDS

SEQ ID NO: 3100 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKHKPPSTNAGRRQKHRLTCPSCDSYEKKPPKEFLERFKSLLQKMIHQHLSSRTHGSEDS

SEQ ID NO: 3101 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKVKPPSTNAGRRQKHRLTCPSCDSYEKKPPKEFLERFKSLLQKMIHQHLSSRTHGSEDS

SEQ ID NO: 3102 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQDAQLKSANTGNNERIINESIKKLKPKVPSTNAGRRQKHRLTCPSCDSYEKKPPKEFLERFKSLLQKMIHQHLSSRTHGSEDS

SEQ ID NO: 3103 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKTKPPSTNAGQDQKHRLTCPSCDSYEKKPPKEFLERFKSLLQKMIHQHLSSRTHGSEDS

SEQ ID NO: 3104 - protein, 162 aa, synthetic construct
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKDKVPSTNAGQDQKHRLTCPSCDSYEKKPPKEFLERFKSLLQKMIHQHLSSRTHGSEDS

SEQ ID NO: 3105 - protein, 162 aa, synthetic construct
MRSSPGNMERIVICLMVIFLGTLVHKSSSQGQDRFMIEMRQLIDIVDQLKNYVNDLVPEFLPAPEDVETNCEWSAFSCFQDAQLKSANTGNNERIINESIKKLKRKPPSDNAGRRQKHRLTCPSCDSYEKKPPKEFLERFKSLLQKMIHQHLSSRTHGSEDS

SEQ ID NO: 3106 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKHKPPSTNAGRRQKHRLTCPSCDSYEKKPPKEFLERFKSLLQKMIHQHLSSRTHGSEDS

SEQ ID NO: 3107 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIDNVSIKKLKRKPPSDNPGRRQKHRLTCPSCDSYEKKPPKEFLERFKSLLQKMIHQHLSSRTHGSEDS

SEQ ID NO: 3108 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIINVSIKKLKSKPPSTNAGRRQKHRLTCPSCDSYEKKPPKEFLERFKSLLQKMIHQHLSSRTHGSEDS

SEQ ID NO: 3109 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKALLKSANTGNNERIINVSIKKLKRKPPSDNPGRRQKHRLTCPSCDSYEKKPPKEFLERFKSLLQKMIHQHLSSRTHGSEDS

SEQ ID NO: 3110 - protein, 162 aa, synthetic construct
MRSSPGNMERIVICLMVIFLGTLVHKSSSQGQDRIMIRMRQLIDIVDQLKNYVNDLVPEFLPAPEDVETGCEWSAFSCFQKAQLKSANTGNNERIINVSIKKLKWKPPSDNPGRRQKHRLTCPSCDSYEKKPPKEFLERFKSLLQKMIHQHLSSRTHGSEDS

SEQ ID NO: 3111 - protein, 162 aa, synthetic construct
MRSSPGNMERIVICLMVIFLGTLVHKSSSQGQDRIMIIMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 3112 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIKNVSIKKLKRKPPSTNAGQDQKHRLTCPSCDSYEKKPPKEFLERFKSLLQKMIHQHLSSRTHGSEDS

SEQ ID NO: 3113 - protein, 162 aa, synthetic construct
MRSSPGNMERIVICLMVIFLGTLVHKSSSQGQDRHMIRMRQLIDTVDQLKNYVNDLVPEFLPAPEDVETNCEWSAFSCFQDAQLKSANTGNNERIINESIKKLKVKPPSTNAGRRQKHRLTCPSCDSYEKKPPKEFLERFKSLLQKMIHQHLSSRTHGSEDS

SEQ ID NO: 3114 - protein, 162 aa, synthetic construct
MRSSPGNMERIVICLMVIFLGTLVHKSSSQGQDRIMIPMRQLIDIVDQLKNYVNDLVPEFLPAPEDVETGCEWSAFSCFQKAQLKSANTGNNERIINVSIKKLKRKPPSDNPGRRQKHRLTCPSCDSYEKKPPKEFLERFKSLLQKMIHQHLSSRTHGSEDS

SEQ ID NO: 3115 - protein, 162 aa, synthetic construct
MRSSPGNMERIVICLMVIFLGTLVHKSSSQGQDRHMIIMRQLIDIVDQLKNYVNDLVPEFLPAPEDVETNCEWSAFSCFQKAQLKSANTGNNERIINVSIKKLKRKVPSTNAGQDQKHRLTCPSCDSYEKKPPKEFLERFKSLLQKMIHQHLSSRTHGSEDS

SEQ ID NO: 3116 - protein, 162 aa, synthetic construct
MRSSPGNMERIVICLMVIFLGTLVHKSSSQGQDRHMIRMRQLIDIVDQLKNYVNDLVPEFLPAPEDVETGCEWSAFSCFQDAQLKSANTGNNERIHNVSIKKLKRKPPSTNAGRRQKHRLTCPSCDSYEKKPPKEFLERFKSLLQKMIHQHLSSRTHGSEDS

SEQ ID NO: 3117 - protein, 162 aa, synthetic construct
MRSSPGNMERIVICLMVIFLGTLVHKSSSQGQDRHMIEMRQLIDIVDQLKNYVNDLVPEFLPAPEDVETGCEWSAFSCFQDAQLKSANTGNNERIINVSIKKLKRKPPSTNAGQDQKHRLTCPSCDSYEKKPPKEFLERFKSLLQKMIHQHLSSRTHGSEDS

SEQ ID NO: 3118 - protein, 6 aa, synthetic construct
HHHHHH

SEQ ID NO: 3119 - protein, 8 aa, synthetic construct
HHHHHHHH

SEQ ID NO: 3120 - protein, 10 aa, synthetic construct
GGGGSGGGGS

SEQ ID NO: 3121 - protein, 15 aa, synthetic construct
GGGGSGGGGSGGGGS

What is claimed is:

1. A human interleukin 21 (IL-21) variant, wherein the IL-21 variant comprises a polypeptide sequence as set forth in any one of SEQ ID NOs: 462, 463, 1192, 950, 933, and 894, or comprises one or more amino acid substitutions at one or more positions of SEQ ID NO: 1 selected from the group consisting of R38W and R105W.

2. A fusion protein comprising:

an antibody or binding fragment thereof; and a human IL-21 variant comprising a polypeptide sequence as set forth in any one of SEQ ID NOs: 462, 463, 1192, 950, 933, and 894, or comprises one or more amino acid substitutions at one or more positions of SEQ ID NO: 1 selected from the group consisting of R38W and R105W, wherein the human IL-21 variant is covalently linked to the antibody or binding fragment thereof.

3. The fusion protein of claim 2, wherein the antibody or binding fragment thereof comprises an Fc domain.

4. The fusion protein of claim 2, wherein the antibody or binding fragment thereof comprises an amino acid sequence as set forth in any one of SEQ ID NOs: 5, 6, 7, 8, 9, 10, 11, 12, 13, and 14.

5. The fusion protein of claim 2, wherein the antibody or binding fragment thereof comprises a human antibody Fc domain comprising an effectorless mutation selected from NG, DANG, LALA, and LALA-PG.

6. The fusion protein of claim 2, wherein the antibody binds to an antigen selected from the group consisting of CD8, TIGIT, PD-1, CD160, BTLA, CD25, ICOS, and TNFRSF9.

7. The fusion protein of claim 6, wherein the antibody is an anti-CD8 antibody.

8. The fusion protein of claim 6, wherein the IL-21 variant is covalently linked to the antibody by a polypeptide linker.

9. The fusion protein of claim 8, wherein the polypeptide linker is selected from the group consisting of (G4S) 2 and (G4S) 3.

10. The fusion protein of claim 8, wherein the polypeptide linker is a polypeptide tag selected from the group consisting of FLAG, MYC, HA, and 6Xhis.

11. A cell line that produces a fusion protein comprising:

an antibody or binding fragment thereof; and a human IL-21 variant comprising a polypeptide sequence as set forth in any one of SEQ ID NOs: 462, 463, 1192, 950, 933, and 894, or comprises one or more amino acid substitutions at one or more positions of SEQ ID NO: 1 selected from the group consisting of R38W and R105W, wherein the IL-21 variant is covalently linked to the antibody or binding fragment thereof.

12. The cell line of claim 11, wherein the cell line is a CHO cell line or a HEK293 cell line.

13. The cell line of claim 11, wherein the antibody or binding fragment thereof comprises an Fc domain.

14. The cell line of claim 11, wherein the antibody or binding fragment thereof comprises an amino acid sequence as set forth in any one of SEQ ID NOs: 5, 6, 7, 8, 9, 10, 11, 12, 13, and 14.

15. The cell line of claim 11, wherein the antibody or binding fragment thereof comprises a human antibody Fc domain comprising an effectorless mutation selected from NG, DANG, LALA, and LALA-PG.

16. The cell line of claim 11, wherein the antibody binds to an antigen selected from the group consisting of CD8, TIGIT, PD-1, CD160, BTLA, CD25, ICOS, and TNERSF9.

17. The cell line of claim 16, wherein the antibody is an anti-CD8 antibody.

18. The cell line of claim 11, wherein the IL-21 variant is covalently linked to the antibody by a polypeptide linker.

19. The cell line of claim 18, wherein the polypeptide linker is selected from the group consisting of (G4S)2 and (G4S)3.

* * * * *